US007371837B2

(12) United States Patent
Yuen et al.

(10) Patent No.: US 7,371,837 B2
(45) Date of Patent: May 13, 2008

(54) HUMAN VIRUS CAUSING RESPIRATORY TRACT INFECTION AND USES THEREOF

(75) Inventors: Kwok Yung Yuen, Hong Kong (CN); Chiu Yat Patrick Woo, Hong Kong (CN); Kar Pui Susanna Lau, Hong Kong (CN); Kwok Hung Chan, Hong Kong (CN)

(73) Assignee: The University of Hong Kong, Hong Kong (HK)

(*) Notice: Subject to any disclaimer, the term of this patent is extended or adjusted under 35 U.S.C. 154(b) by 212 days.

(21) Appl. No.: 11/129,741

(22) Filed: May 16, 2005

(65) Prior Publication Data

US 2006/0034853 A1 Feb. 16, 2006

Related U.S. Application Data

(63) Continuation-in-part of application No. 10/895,064, filed on Jul. 21, 2004.

(51) Int. Cl.

*C07H 21/02* (2006.01)
*C12N 15/00* (2006.01)
*A61K 39/00* (2006.01)
*A61K 39/12* (2006.01)

(52) U.S. Cl. ............... 536/23.1; 435/320.1; 530/185.1; 530/186.1

(58) Field of Classification Search ..................... None
See application file for complete search history.

(56) References Cited

U.S. PATENT DOCUMENTS

2005/0266397 A1* 12/2005 Exker et al. ................... 435/5

OTHER PUBLICATIONS

Zhao et al., "DNA Vaccine of SARS-Cov S Gene Induces Antibody Response in Mice"; Acta Biochim et Biophysica Sinica 2004, 36(1):37-41 CN 31-1300/Q.

Yount et al., "Systematic assembly of a full-length infectious cDNA of mouse hepatitis virus strain A59", Journal of Virology, vol. 76, No. 21, pp. 11065-11078 (Nov. 2002).

Entraz Accession No. NC 001846, Jul. 7, 1997.

Woo et al., "Phylogenetic and recombination analysis of coronavirus HKU1, a novel coronavirus from patients with pneumonia", Arch Virol., vol. 150, pp. 2299-2311 (2005).

* cited by examiner

*Primary Examiner*—Bruce Campell
*Assistant Examiner*—Bo Peng
(74) *Attorney, Agent, or Firm*—Dickstein Shapiro LLP

(57) ABSTRACT

The present invention provides the complete genomic sequence of a novel human coronavirus, coined as human coronavirus-HKU1 ("CoV-HKU1"), isolated in Hong Kong. The virus belongs to the order Nidovirales of the family Coronaviridae, being a single-stranded RNA virus of positive polarity. Further study on nasopharyngeal aspirates from patients with community-acquired pneumonia has revealed that there are two genotypes, genotype A and genotype B, for this virus. In addition to the genomic sequences of these two genotypes, the invention provides the deduced amino acid sequences of the complete genome of the CoV-HKU1. The nucleotide sequences and deduced amino acid sequences of the CoV-HKU1 are useful in preventing, diagnosing and/or treating the infection by CoV-HKU1. Furthermore, the invention provides immunogenic and vaccine preparations using recombinant and chimeric forms as well as subunits of the CoV-HKU1 based on the nucleotide sequences and deduced amino acid sequences of the CoV-HKU1.

8 Claims, 201 Drawing Sheets

Figure 4:
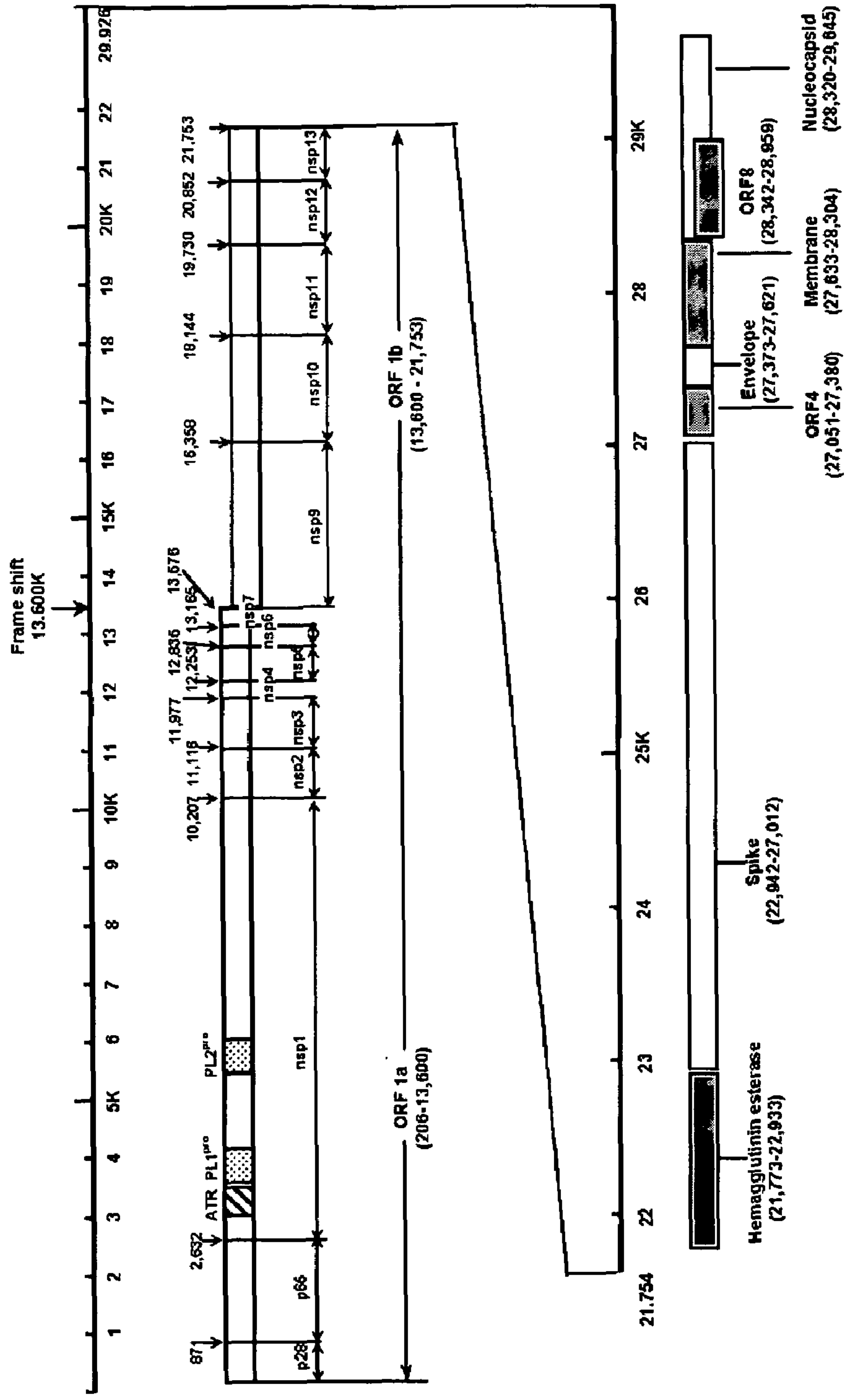

| | | | |
|---|---|---|---|
| SEQ:1 | 1 | TCGTGCTATGCCAAATATTTTGCGTATTGTTAGTAGTTTAGTTTTGGCCCGCAAACAT | 58 |
| SEQ:2 | 1 | R A M P N I L R I V S S L V L A R K H | 19 |
| | 59 | GAATTTTGTTGTTCACATGGTGATAGATTTTATCGCCTTGCGAATGAATGTGCTCAAGTT | 118 |
| | 20 | E F C C S H G D R F Y R L A N E C A Q V | 39 |
| | 119 | TTGAGTGAAATAGTTATGTGTGGCGGTTGCTATTATGTTAAGCCTGGTGGTACTAGCAGT | 178 |
| | 40 | L S E I V M C G G C Y Y V K P G G T S S | 59 |
| | 179 | GGTGATGCAACTACTGCTTTTGCTAATTCTGTTTTTAATATATGTCAGGCTGTTACTGCT | 238 |
| | 60 | G D A T T A F A N S V F N I C Q A V T A | 79 |
| | 239 | AATGTTTGTTCTCTTATGGCCTGTAATGGCCATAAGATTGAAGATTTAAGTATACGCAAT | 298 |
| | 80 | N V C S L M A C N G H K I E D L S I R N | 99 |
| | 299 | TTACAAAAACGCTTATACTCTAATGTTTATCGTACAGATTATGTTGATTATACATTTGTT | 358 |
| | 100 | L Q K R L Y S N V Y R T D Y V D Y T F V | 119 |
| | 359 | AATGAGTATTATGAATTTTTATGTAAGCATTTTAG | 393 |
| | 120 | N E Y Y E F L C K H F | 130 |

FIG. 1

```
SEQ:3   1   GAATAAGAGCGAATTGCGTCCGTACCGTCTATCAGCTTACGATCTCTTGTCAGATCTCAT   60
            E  *  E  R  I  A  S  V  P  S  I  S  L  R  S  L  V  R  S  H
             N  K  S  E  L  R  P  Y  R  L  S  A  Y  D  L  L  S  D  L  I
              I  R  A  N  C  V  R  T  V  Y  Q  L  T  I  S  C  Q  I  S  L

       61   TAAATCTAAACTTTTTAAACAAGATTCCCTGTTATCCATGCTTGTGAGTGTGGTTTAATC   120
            *  I  *  T  F  *  T  R  F  P  V  I  H  A  C  E  C  G  L  I
             K  S  K  L  F  K  Q  D  S  L  L  S  M  L  V  S  V  V  *  S
              N  L  N  F  L  N  K  I  P  C  Y  P  C  L  *  V  W  F  N  H

      121   ATAATCTTGTATTTTACTTTCCACACTTTTCATCTCTCTGCCAGTGACGTGTTGGTTGTC   180
            I  I  L  Y  F  T  F  H  T  F  H  L  S  A  S  D  V  L  V  V
             *  S  C  I  L  L  S  T  L  F  I  S  L  P  V  T  C  W  L  S
              N  L  V  F  Y  F  P  H  F  S  S  L  C  Q  *  R  V  G  C  P

      181   CTCAGCGTCCCTCCCATAGGTCGCAATGATTAAAACCAGCAAATACGGTCTCGGCTTCAA   240
            L  S  V  P  P  I  G  R  N  D  *  N  Q  Q  I  R  S  R  L  Q
             S  A  S  L  P  *  V  A  M  I  K  T  S  K  Y  G  L  G  F  K
              Q  R  P  S  H  R  S  Q  *  L  K  P  A  N  T  V  S  A  S  S

      241   GTGGGCGCCAGAATTTCGTTGGCTGCTTCCGGATGCAGCGGAGGAGTTGGCTAGTCCTAT   300
            V  G  A  R  I  S  L  A  A  S  G  C  S  G  G  V  G  *  S  Y
             W  A  P  E  F  R  W  L  L  P  D  A  A  E  E  L  A  S  P  M
              G  R  Q  N  F  V  G  C  F  R  M  Q  R  R  S  W  L  V  L  *

      301   GAAGTCAGATGAGGGTGGGTTATGCCCCTCTACTGGTCAAGCGATGGAAAGTGTTGGATT   360
            E  V  R  *  G  W  V  M  P  L  Y  W  S  S  D  G  K  C  W  I
             K  S  D  E  G  G  L  C  P  S  T  G  Q  A  M  E  S  V  G  F
              S  Q  M  R  V  G  Y  A  P  L  L  V  K  R  W  K  V  L  D  S

      361   CGTTTATGATAATCATGTGAAGATAGATTGTCGCTGCATTCTTGGACAAGAATGGCATGT   420
            R  L  *  *  S  C  E  D  R  L  S  L  H  S  W  T  R  M  A  C
             V  Y  D  N  H  V  K  I  D  C  R  C  I  L  G  Q  E  W  H  V
              F  M  I  I  M  *  R  *  I  V  A  A  F  L  D  K  N  G  M  C

      421   GCAGTCAAATCTTATCCGTGATATTTTTGTTCATGAAGATCTACATGTTGTAGAAGTTCT   480
            A  V  K  S  Y  P  *  Y  F  C  S  *  R  S  T  C  C  R  S  S
             Q  S  N  L  I  R  D  I  F  V  H  E  D  L  H  V  V  E  V  L
              S  Q  I  L  S  V  I  F  L  F  M  K  I  Y  M  L  *  K  F  *

      481   AACTAAAACAGCCGTAAAGTCCGGTACGGCAATTTTAATTAAATCACCTTTGCATAGCTT   540
            N  *  N  S  R  K  V  R  Y  G  N  F  N  *  I  T  F  A  *  L
             T  K  T  A  V  K  S  G  T  A  I  L  I  K  S  P  L  H  S  L
              L  K  Q  P  *  S  P  V  R  Q  F  *  L  N  H  L  C  I  A  W
```

FIG. 2

```
541   GGGTGGTTTTCCTAAAGGGTATGTTATGGGCTTGTTCCGTTCATACAAGACTAAACGTTA   600
      G  W  F  S  *  R  V  C  Y  G  L  V  P  F  I  Q  D  *  T  L
       G  G  F  P  K  G  Y  V  M  G  L  F  R  S  Y  K  T  K  R  Y
        V  V  F  L  K  G  M  L  W  A  C  S  V  H  T  R  L  N  V  M

601   TGTTGTACATCATCTTTCTATGACTACATCTACTACTAATTTTGGTGAAGATTTTTTGGG   660
      C  C  T  S  S  F  Y  D  Y  I  Y  Y  *  F  W  *  R  F  F  G
       V  V  H  H  L  S  M  T  T  S  T  T  N  F  G  E  D  F  L  G
        L  Y  I  I  F  L  *  L  H  L  L  L  I  L  V  K  I  F  W  V

661   TTGGATTGTACCTTTTGGTTTTATGCCATCTTATGTTCACAAATGGTTTCAATTCTGTAG   720
      L  D  C  T  F  W  F  Y  A  I  L  C  S  Q  M  V  S  I  L  *
       W  I  V  P  F  G  F  M  P  S  Y  V  H  K  W  F  Q  F  C  R
        G  L  Y  L  L  V  L  C  H  L  M  F  T  N  G  F  N  S  V  G

721   GTTGTATATTGAAGAGAGTGATTTAATAATTTCAAATTTTAAATTTGATGATTATGATTT   780
      V  V  Y  *  R  E  *  F  N  N  F  K  F  *  I  *  *  L  *  F
       L  Y  I  E  E  S  D  L  I  I  S  N  F  K  F  D  D  Y  D  F
        C  I  L  K  R  V  I  *  *  F  Q  I  L  N  L  M  I  M  I  L

781   TAGTGTAGAAGATGCTTATGCTGAGGTTCATGCTGAGCCTAAAGGTAAATATTCACAAAA   840
      *  C  R  R  C  L  C  *  G  S  C  *  A  *  R  *  I  F  T  K
       S  V  E  D  A  Y  A  E  V  H  A  E  P  K  G  K  Y  S  Q  K
        V  *  K  M  L  M  L  R  F  M  L  S  L  K  V  N  I  H  K  K

841   AGCTTATGCTTTACTTAGACAATATCGTGGTATTAAACCCGTACTTTTTGTAGACCAGTA   900
      S  L  C  F  T  *  T  I  S  W  Y  *  T  R  T  F  C  R  P  V
       A  Y  A  L  L  R  Q  Y  R  G  I  K  P  V  L  F  V  D  Q  Y
        L  M  L  Y  L  D  N  I  V  V  L  N  P  Y  F  L  *  T  S  M

901   TGGTTGTGACTATTCTGGTAAATTAGCAGATTGTCTTCAAGCTTATGGTCATTATTCTTT   960
      W  L  *  L  F  W  *  I  S  R  L  S  S  S  L  W  S  L  F  F
       G  C  D  Y  S  G  K  L  A  D  C  L  Q  A  Y  G  H  Y  S  L
        V  V  T  I  L  V  N  *  Q  I  V  F  K  L  M  V  I  I  L  C

961   GCAAGATATGAGACAAAAGCAGTCTGTATGGCTTGCCAATTGTGACTTTGATATTGTAGT   1020
      A  R  Y  E  T  K  A  V  C  M  A  C  Q  L  *  L  *  Y  C  S
       Q  D  M  R  Q  K  Q  S  V  W  L  A  N  C  D  F  D  I  V  V
        K  I  *  D  K  S  S  L  Y  G  L  P  I  V  T  L  I  L  *  W

1021  GGCTTGGCATGTAGTTCGTGATTCACGATTTGTTATGCGCCTGCAGACTATAGCTACTAT   1080
      G  L  A  C  S  S  *  F  T  I  C  Y  A  P  A  D  Y  S  Y  Y
       A  W  H  V  V  R  D  S  R  F  V  M  R  L  Q  T  I  A  T  I
        L  G  M  *  F  V  I  H  D  L  L  C  A  C  R  L  *  L  L  F
```

FIG. 2 CONT.

```
1081   TTGTGGTATTAAATATGTTGCACAACCTACAGAAGATGTAGTAGATGGAGATGTAGTTAT   1140
       L  W  Y  *  I  C  C  T  T  Y  R  R  C  S  R  W  R  C  S  Y
        C  G  I  K  Y  V  A  Q  P  T  E  D  V  V  D  G  D  V  V  I
         V  V  L  N  M  L  H  N  L  Q  K  M  *  *  M  E  M  *  L  Y

1141   ACGTGAACCTGTACATTTATTATCTGCTGATGCAATAGTTTTAAAGCTTCCTAGTTTGAT   1200
       T  *  T  C  T  F  I  I  C  *  C  N  S  F  K  A  S  *  F  D
        R  E  P  V  H  L  L  S  A  D  A  I  V  L  K  L  P  S  L  M
         V  N  L  Y  I  Y  Y  L  L  M  Q  *  F  *  S  F  L  V  *  *

1201   GAAAGTTATGACTCATATGGATGATTTTTCTATTAAATCTATATATAATGTTGATTTGTG   1260
       E  S  Y  D  S  Y  G  *  F  F  Y  *  I  Y  I  *  C  *  F  V
        K  V  M  T  H  M  D  D  F  S  I  K  S  I  Y  N  V  D  L  C
         K  L  *  L  I  W  M  I  F  L  L  N  L  Y  I  M  L  I  C  V

1261   TGATTGTGGTTTTGTTATGCAGTATGGTTATGTAGATTGTTTTAATGATAATTGTGATTT   1320
       *  L  W  F  C  Y  A  V  W  L  C  R  L  F  *  *  *  L  *  F
        D  C  G  F  V  M  Q  Y  G  Y  V  D  C  F  N  D  N  C  D  F
         I  V  V  L  L  C  S  M  V  M  *  I  V  L  M  I  I  V  I  F

1321   TTATGGTTGGGTTTCAGGTAATATGATGGATGGTTTTTCTTGTCCATTGTGTTGTACAGT   1380
       L  W  L  G  F  R  *  Y  D  G  W  F  F  L  S  I  V  L  Y  S
        Y  G  W  V  S  G  N  M  M  D  G  F  S  C  P  L  C  C  T  V
         M  V  G  F  Q  V  I  *  W  M  V  F  L  V  H  C  V  V  Q  F

1381   TTATGACTCTAGCGAAGTTAAAGCCCAATCATCTGGTGTTATTCCTGAAAATCCTGTGTT   1440
       L  *  L  *  R  S  *  S  P  I  I  W  C  Y  S  *  K  S  C  V
        Y  D  S  S  E  V  K  A  Q  S  S  G  V  I  P  E  N  P  V  L
         M  T  L  A  K  L  K  P  N  H  L  V  L  F  L  K  I  L  C  Y

1441   ATTTACTAATAGTACTGATACTGTTAACCATGATTCTTTTAATTTGTATGGTTATTCTGT   1500
       I  Y  *  *  Y  *  Y  C  *  P  *  F  F  *  F  V  W  L  F  C
        F  T  N  S  T  D  T  V  N  H  D  S  F  N  L  Y  G  Y  S  V
         L  L  I  V  L  I  L  L  T  M  I  L  L  I  C  M  V  I  L  S

1501   CACACCATTTGGTTCTTGTATATATTGGTCGCCGCGTCCTGGATTGTGGATTCCTATAAT   1560
       H  T  I  W  F  L  Y  I  L  V  A  A  S  W  I  V  D  S  Y  N
        T  P  F  G  S  C  I  Y  W  S  P  R  P  G  L  W  I  P  I  I
         H  H  L  V  L  V  Y  I  G  R  R  V  L  D  C  G  F  L  *  L

1561   TAAATCTTCAGTCAAGTCTTATGATGATTTGGTTTATTCAGGTGTAGTAGGTTGTAAATC   1620
       *  I  F  S  Q  V  L  *  *  F  G  L  F  R  C  S  R  L  *  I
        K  S  S  V  K  S  Y  D  D  L  V  Y  S  G  V  V  G  C  K  S
         N  L  Q  S  S  L  M  M  I  W  F  I  Q  V  *  *  V  V  N  L
```

FIG. 2 CONT.

```
1621   TATTGTTAAAGAAACTGCTCTTATTACTCATGCACTTTACTTAGATTATGTTCAATGTAA   1680
       Y  C  *  R  N  C  S  Y  Y  S  C  T  L  L  R  L  C  S  M  *
        I  V  K  E  T  A  L  I  T  H  A  L  Y  L  D  Y  V  Q  C  K
         L  L  K  K  L  L  L  L  L  M  H  F  T  *  I  M  F  N  V  S

1681   GTGTGGTAATCTTGAACAAAATCATATTCTTGGCGTTAATAATTCTTGGTGTAGGCAACT   1740
       V  W  *  S  *  T  K  S  Y  S  W  R  *  *  F  L  V  *  A  T
        C  G  N  L  E  Q  N  H  I  L  G  V  N  N  S  W  C  R  Q  L
         V  V  I  L  N  K  I  I  F  L  A  L  I  I  L  G  V  G  N  C

1741   GTTGCTTAATAGAGGTGATTATAATATGCTTCTAAAAAATATTGACTTGTTTGTTAAGCG   1800
       V  A  *  *  R  *  L  *  Y  A  S  K  K  Y  *  L  V  C  *  A
        L  L  N  R  G  D  Y  N  M  L  L  K  N  I  D  L  F  V  K  R
         C  L  I  E  V  I  I  I  C  F  *  K  I  L  T  C  L  L  S  V

1801   TCGTGCTGATTTTGCTTGCAAGTTTGCAGTTTGTGGAGATGGTTTTGTACCTTTTTTACT   1860
       S  C  *  F  C  L  Q  V  C  S  L  W  R  W  F  C  T  F  F  T
        R  A  D  F  A  C  K  F  A  V  C  G  D  G  F  V  P  F  L  L
         V  L  I  L  L  A  S  L  Q  F  V  E  M  V  L  Y  L  F  Y  *

1861   AGATGGTTTAATTCCCCGTAGTTATTATCTAATTCAGAGTGGTATTTTCTTTACATCTTT   1920
       R  W  F  N  S  P  *  L  L  S  N  S  E  W  Y  F  L  Y  I  F
        D  G  L  I  P  R  S  Y  Y  L  I  Q  S  G  I  F  F  T  S  L
         M  V  *  F  P  V  V  I  I  *  F  R  V  V  F  S  L  H  L  *

1921   GATGTCTCAATTTTCACAAGAAGTTTCTGATATGTGTTTAAAAATGTGTATTTTGTTTAT   1980
       D  V  S  I  F  T  R  S  F  *  Y  V  F  K  N  V  Y  F  V  Y
        M  S  Q  F  S  Q  E  V  S  D  M  C  L  K  M  C  I  L  F  M
         C  L  N  F  H  K  K  F  L  I  C  V  *  K  C  V  F  C  L  W

1981   GGACAGAGTTTCAGTTGCTACATTTTATATAGAGCATTATGTTAATAGGTTGGTTACTCA   2040
       G  Q  S  F  S  C  Y  I  L  Y  R  A  L  C  *  *  V  G  Y  S
        D  R  V  S  V  A  T  F  Y  I  E  H  Y  V  N  R  L  V  T  Q
         T  E  F  Q  L  L  H  F  I  *  S  I  M  L  I  G  W  L  L  N

2041   ATTTAAGTTATTGGGTACTACACTTGTTAATAAAATGGTTAATTGGTTTAATACCATGTT   2100
       I  *  V  I  G  Y  Y  T  C  *  *  N  G  *  L  V  *  Y  H  V
        F  K  L  L  G  T  T  L  V  N  K  M  V  N  W  F  N  T  M  L
         L  S  Y  W  V  L  H  L  L  I  K  W  L  I  G  L  I  P  C  *

2101   AGATGCTAGTGCACCTGCTACAGGCTGGCTTCTTTACCAATTATTGAATGGTCTTTTTGT   2160
       R  C  *  C  T  C  Y  R  L  A  S  L  P  I  I  E  W  S  F  C
        D  A  S  A  P  A  T  G  W  L  L  Y  Q  L  L  N  G  L  F  V
         M  L  V  H  L  L  Q  A  G  F  F  T  N  Y  *  M  V  F  L  *
```

FIG. 2 CONT.

```
2161  AGTATCTCAAGCCAACTTTAATTTTGTTGCTTTAATACCTGATTATGCTAAAATTTTAGT  2220
      S  I  S  S  Q  L  *  F  C  C  F  N  T  *  L  C  *  N  F  S
       V  S  Q  A  N  F  N  F  V  A  L  I  P  D  Y  A  K  I  L  V
        Y  L  K  P  T  L  I  L  L  L  *  Y  L  I  M  L  K  F  *  L

2221  TAATAAATTTTACACTTTTTTTAAGTTATTATTAGAGTGTGTTACAGTTGATGTTTTAAA  2280
      *  *  I  L  H  F  F  *  V  I  I  R  V  C  Y  S  *  C  F  K
       N  K  F  Y  T  F  F  K  L  L  L  E  C  V  T  V  D  V  L  K
        I  N  F  T  L  F  L  S  Y  Y  *  S  V  L  Q  L  M  F  *  K

2281  AGATATGCCTGTTCTTAAAACTATTAATGGTTTAGTTTGTATTGTAGGCAATAAGTTTTA  2340
      R  Y  A  C  S  *  N  Y  *  W  F  S  L  Y  C  R  Q  *  V  L
       D  M  P  V  L  K  T  I  N  G  L  V  C  I  V  G  N  K  F  Y
        I  C  L  F  L  K  L  L  M  V  *  F  V  L  *  A  I  S  F  I

2341  TAACGTTAGTACAGGGTTAATTCCTGGTTTTGTTTTACCATGTAATGCACAGGAACAACA  2400
      *  R  *  Y  R  V  N  S  W  F  C  F  T  M  *  C  T  G  T  T
       N  V  S  T  G  L  I  P  G  F  V  L  P  C  N  A  Q  E  Q  Q
        T  L  V  Q  G  *  F  L  V  L  F  Y  H  V  M  H  R  N  N  K

2401  AATTTATTTTTTTGAAGGCGTTGCAGAATCTGTTATAGTAGAAGATGATGTTATTGAGAA  2460
      N  L  F  F  *  R  R  C  R  I  C  Y  S  R  R  *  C  Y  *  E
       I  Y  F  F  E  G  V  A  E  S  V  I  V  E  D  D  V  I  E  N
        F  I  F  L  K  A  L  Q  N  L  L  *  *  K  M  M  L  L  R  M

2461  TGTCAAATCTTCTTTATCATCTTATGAGTATTGTCAACCACCTAAATCTGTAGAAAAAAT  2520
      C  Q  I  F  F  I  I  L  *  V  L  S  T  T  *  I  C  R  K  N
       V  K  S  S  L  S  S  Y  E  Y  C  Q  P  P  K  S  V  E  K  I
        S  N  L  L  Y  H  L  M  S  I  V  N  H  L  N  L  *  K  K  F

2521  TTGTATTATAGATAATATGTACATGGGTAAGTGTGGTGATAAATTTTTCCCTATTGTCAT  2580
      L  Y  Y  R  *  Y  V  H  G  *  V  W  *  *  I  F  P  Y  C  H
       C  I  I  D  N  M  Y  M  G  K  C  G  D  K  F  F  P  I  V  M
        V  L  *  I  I  C  T  W  V  S  V  V  I  N  F  S  L  L  S  *

2581  GAATGATAAAAATATTTGTCTTTTAGATCAGGCTTGGCGTTTTCCATGTGCAGGTAGAAA  2640
      E  *  *  K  Y  L  S  F  R  S  G  L  A  F  S  M  C  R  *  K
       N  D  K  N  I  C  L  L  D  Q  A  W  R  F  P  C  A  G  R  K
        M  I  K  I  F  V  F  *  I  R  L  G  V  F  H  V  Q  V  E  K

2641  AGTTAATTTTAACGAGAAACCTGTTGTTATGGAGATTCCGTCTTTGATGACAGTTAAGGT  2700
      S  *  F  *  R  E  T  C  C  Y  G  D  S  V  F  D  D  S  *  G
       V  N  F  N  E  K  P  V  V  M  E  I  P  S  L  M  T  V  K  V
        L  I  L  T  R  N  L  L  L  W  R  F  R  L  *  *  Q  L  R  L
```

FIG. 2 CONT.

```
2701   TATGTTTGATTTAGATTCTACTTTTGATGATATTTTAGGTAAAGTTTGTTCAGAATTTGA   2760
       Y  V  *  F  R  F  Y  F  *  *  Y  F  R  *  S  L  F  R  I  *
        M  F  D  L  D  S  T  F  D  D  I  L  G  K  V  C  S  E  F  E
         C  L  I  *  I  L  L  L  M  I  F  *  V  K  F  V  Q  N  L  K

2761   AGTAGAAAAGGGTGTTACTGTAGATGATTTTGTTGCTGTTGTTTGTGATGCTATAGAGAA   2820
       S  R  K  G  C  Y  C  R  *  F  C  C  C  C  L  *  C  Y  R  E
        V  E  K  G  V  T  V  D  D  F  V  A  V  V  C  D  A  I  E  N
         *  K  R  V  L  L  *  M  I  L  L  L  L  F  V  M  L  *  R  M

2821   TGCTTTAAACTCTTGTAAAGAGCATCCAGTGGTTGGTTATCAAGTTCGTGCATTTTTAAA   2880
       C  F  K  L  L  *  R  A  S  S  G  W  L  S  S  S  C  I  F  K
        A  L  N  S  C  K  E  H  P  V  V  G  Y  Q  V  R  A  F  L  N
         L  *  T  L  V  K  S  I  Q  W  L  V  I  K  F  V  H  F  *  I

2881   TAAACTTAATGAGAATGTTGTTTATTTATTTGATGAGGCTGGTGATGAAGCAATGGCCTC   2940
       *  T  *  *  E  C  C  L  F  I  *  *  G  W  *  *  S  N  G  L
        K  L  N  E  N  V  V  Y  L  F  D  E  A  G  D  E  A  M  A  S
         N  L  M  R  M  L  F  I  Y  L  M  R  L  V  M  K  Q  W  P  L

2941   TCGTATGTATTGTACTTTTGCTATTGAGGATGTTGAAGACGTTATCAGTAGTGAAGCTGT   3000
       S  Y  V  L  Y  F  C  Y  *  G  C  *  R  R  Y  Q  *  *  S  C
        R  M  Y  C  T  F  A  I  E  D  V  E  D  V  I  S  S  E  A  V
         V  C  I  V  L  L  L  L  R  M  L  K  T  L  S  V  V  K  L  S

3001   CGAAGATACTATTGATGGTGTCGTTGAAGACACTATTAATGACGATGAAGATGTTGTTAC   3060
       R  R  Y  Y  *  W  C  R  *  R  H  Y  *  *  R  *  R  C  C  Y
        E  D  T  I  D  G  V  V  E  D  T  I  N  D  D  E  D  V  V  T
         K  I  L  L  M  V  S  L  K  T  L  L  M  T  M  K  M  L  L  L

3061   TGGTGACAATGACGATGAAGATGTTGTTACTGGTGACAATGACGATGAAGATGTTGTTAC   3120
       W  *  Q  *  R  *  R  C  C  Y  W  *  Q  *  R  *  R  C  C  Y
        G  D  N  D  D  E  D  V  V  T  G  D  N  D  D  E  D  V  V  T
         V  T  M  T  M  K  M  L  L  L  V  T  M  T  M  K  M  L  L  L

3121   TGGTGACAATGACGATGAAGATGTTGTTACTGGTGACAATGACGATGAAGATGTTGTTAC   3180
       W  *  Q  *  R  *  R  C  C  Y  W  *  Q  *  R  *  R  C  C  Y
        G  D  N  D  D  E  D  V  V  T  G  D  N  D  D  E  D  V  V  T
         V  T  M  T  M  K  M  L  L  L  V  T  M  T  M  K  M  L  L  L

3181   TGGTGACAATGACGATGAAGATGTTGTTACTGGTGACAATGACGATGAAGATGTTGTTAC   3240
       W  *  Q  *  R  *  R  C  C  Y  W  *  Q  *  R  *  R  C  C  Y
        G  D  N  D  D  E  D  V  V  T  G  D  N  D  D  E  D  V  V  T
         V  T  M  T  M  K  M  L  L  L  V  T  M  T  M  K  M  L  L  L
```

FIG. 2 CONT.

```
3241    TGGTGACAATGACGATGAAGATGTTGTTACTGGTGACAATGACGATGAAGATGTTGTTAC    3300
        W  *  Q  *  R  *  R  C  C  Y  W  *  Q  *  R  *  R  C  C  Y
         G  D  N  D  D  E  D  V  V  T  G  D  N  D  D  E  D  V  V  T
          V  T  M  T  M  K  M  L  L  L  V  T  M  T  M  K  M  L  L  L

3301    TGGTGACAATGACGATGAAGATGTTGTTACTGGTGACAATGACGATGAAGATGTTGTTAC    3360
        W  *  Q  *  R  *  R  C  C  Y  W  *  Q  *  R  *  R  C  C  Y
         G  D  N  D  D  E  D  V  V  T  G  D  N  D  D  E  D  V  V  T
          V  T  M  T  M  K  M  L  L  L  V  T  M  T  M  K  M  L  L  L

3361    TGGTGACAATGACGATGAAGATGTTGTTACTGGTGACAATGACGATGAAGATGTTGTTAC    3420
        W  *  Q  *  R  *  R  C  C  Y  W  *  Q  *  R  *  R  C  C  Y
         G  D  N  D  D  E  D  V  V  T  G  D  N  D  D  E  D  V  V  T
          V  T  M  T  M  K  M  L  L  L  V  T  M  T  M  K  M  L  L  L

3421    TGGTGACAATGACGATGAAGATGTTGTTACTGGTGACAATAACGATGAAGAGATTGTTAC    3480
        W  *  Q  *  R  *  R  C  C  Y  W  *  Q  *  R  *  R  D  C  Y
         G  D  N  D  D  E  D  V  V  T  G  D  N  N  D  E  E  I  V  T
          V  T  M  T  M  K  M  L  L  L  V  T  I  T  M  K  R  L  L  L

3481    TGGTGACAATGATGACCAAATTGTTGTTACTGGTGATGATGTAGATGATATTGAAAGTAT    3540
        W  *  Q  *  *  P  N  C  C  Y  W  *  *  C  R  *  Y  *  K  Y
         G  D  N  D  D  Q  I  V  V  T  G  D  D  V  D  D  I  E  S  I
          V  T  M  M  T  K  L  L  L  L  V  M  M  *  M  I  L  K  V  F

3541    TTATGACTTTGATACTTATAAAGCTCTTTTAGTTTTTAATGATGTCTATAATGATGCTTT    3600
        L  *  L  *  Y  L  *  S  S  F  S  F  *  *  C  L  *  *  C  F
         Y  D  F  D  T  Y  K  A  L  L  V  F  N  D  V  Y  N  D  A  L
          M  T  L  I  L  I  K  L  F  *  F  L  M  M  S  I  M  M  L  C

3601    GTTTGTTAGTTATGGTTCTAGTGTTGAAACAGAAACATATTTTAAAGTTAATGGTTTATG    3660
        V  C  *  L  W  F  *  C  *  N  R  N  I  F  *  S  *  W  F  M
         F  V  S  Y  G  S  S  V  E  T  E  T  Y  F  K  V  N  G  L  W
          L  L  V  M  V  L  V  L  K  Q  K  H  I  L  K  L  M  V  Y  G

3661    GTCACCTACTATTACACATACTAATTGTTGGTTGCGTTCTGTGTTACTTGTAATGCAGAA    3720
        V  T  Y  Y  Y  T  Y  *  L  L  V  A  F  C  V  T  C  N  A  E
         S  P  T  I  T  H  T  N  C  W  L  R  S  V  L  L  V  M  Q  K
          H  L  L  L  H  I  L  I  V  G  C  V  L  C  Y  L  *  C  R  N

3721    ATTACCTTTTAAGTTTAAGGATTTAGCTATTGAAAATATGTGGTTATCTTATAAGGTGGG    3780
        I  T  F  *  V  *  G  F  S  Y  *  K  Y  V  V  I  L  *  G  G
         L  P  F  K  F  K  D  L  A  I  E  N  M  W  L  S  Y  K  V  G
          Y  L  L  S  L  R  I  *  L  L  K  I  C  G  Y  L  I  R  W  V
```

FIG. 2 CONT.

```
3781  TTATAATCAAAGTTTTGTTGATTATTTACTGACCACTATTCCTAAAGCTATTGTTTTGCC  3840
       L * S K F C * L F T D H Y S * S Y C F A
        Y N Q S F V D Y L L T T I P K A I V L P
         I I K V L L I I Y * P L F L K L L F C L

3841  TCAAGGTGGTTTTGTAGCTGATTTTGCTTATTGGTTTTTAAACCAGTTTGATATTAATGC  3900
       S R W F C S * F C L L V F K P V * Y * C
        Q G G F V A D F A Y W F L N Q F D I N A
         K V V L * L I L L I G F * T S L I L M R

3901  GTATGCTAATTGGTGTTGTTTAAAATGTGGTTTTTCTTTTGATTTAAATGGTTTGGATGC  3960
       V C * L V L F K M W F F F * F K W F G C
        Y A N W C C L K C G F S F D L N G L D A
         M L I G V V * N V V F L L I * M V W M L

3961  TTTGTTTTTTTATGGAGATATTGTGTCTCATGTTTGTAAGTGTGGACATAATATGACTCT  4020
       F V F L W R Y C V S C L * V W T * Y D S
        L F F Y G D I V S H V C K C G H N M T L
         C F F M E I L C L M F V S V D I I . * L *

4021  AATAGCAGCGGACTTACCTTGTACATTACATTTTTCATTATTTGATGACAATTTTTGTGC  4080
       N S S G L T L Y I T F F I I * * Q F L C
        I A A D L P C T L H F S L F D D N F C A
         * Q R T Y L V H Y I F H Y L M T I F V L

4081  TTTTTGCACCCCTAAAAAAATTTTTATTGCTGCATGTGCTGTGGATGTAAACGTTTGTCA  4140
       F L H P * K N F Y C C M C C G C K R L S
        F C T P K K I F I A A C A V D V N V C H
         F A P L K K F L L L H V L W M * T F V I

4141  TTCTGTAGCTGTTATAGGTGATGAACAAATAGATGGTAAGTTTGTTACTAAATTTAGTGG  4200
       F C S C Y R * * T N R W * V C Y * I * W
        S V A V I G D E Q I D G K F V T K F S G
         L * L L * V M N K * M V S L L L N L V V

4201  TGATAAATTTGATTTTATAGTAGGTTATGGAATGTCATTTAGTATGTCTTCTTTTGAGTT  4260
       * * I * F Y S R L W N V I * Y V F F * V
        D K F D F I V G Y G M S F S M S S F E L
         I N L I L * * V M E C H L V C L L L S Y

4261  ACCTCAATTGTATGGTTTGTGTATAACACCTAATGTATGTTTTGTTAAAGGTGATATTAT  4320
       T S I V W F V Y N T * C M F C * R * Y Y
        P Q L Y G L C I T P N V C F V K G D I I
         L N C M V C V * H L M Y V L L K V I L *
```

FIG. 2 CONT.

```
4321   AAATGTTGCTAGACTTGTTAAAGCTGATGTTATTGTTAATCCTGCTAATGGGCATATGCT   4380
       K  C  C  *  T  C  *  S  *  C  Y  C  *  S  C  *  W  A  Y  A
        N  V  A  R  L  V  K  A  D  V  I  V  N  P  A  N  G  H  M  L
         M  L  L  D  L  L  K  L  M  L  L  L  I  L  L  M  G  I  C  S

4381   CCATGGTGGTGGAGTTGCAAAAGCTATAGCTGTAGCTGCAGGTAAAAAATTTTCTAAAGA   4440
       P  W  W  W  S  C  K  S  Y  S  C  S  C  R  *  K  I  F  *  R
        H  G  G  G  V  A  K  A  I  A  V  A  A  G  K  K  F  S  K  E
         M  V  V  E  L  Q  K  L  *  L  *  L  Q  V  K  N  F  L  K  K

4441   AACTGCTGCTATGGTTAAATCTAAAGGTGTTTGCCAAGTAGGAGATTGTTATGTTTCTAC   4500
       N  C  C  Y  G  *  I  *  R  C  L  P  S  R  R  L  L  C  F  Y
        T  A  A  M  V  K  S  K  G  V  C  Q  V  G  D  C  Y  V  S  T
         L  L  L  W  L  N  L  K  V  F  A  K  *  E  I  V  M  F  L  P

4501   CGGTGGTAAATTATGTAAAACAATTCTTAATATTGTAGGCCCTGATGCTAGACAAGATGG   4560
       R  W  *  I  M  *  N  N  S  *  Y  C  R  P  *  C  *  T  R  W
        G  G  K  L  C  K  T  I  L  N  I  V  G  P  D  A  R  Q  D  G
         V  V  N  Y  V  K  Q  F  L  I  L  *  A  L  M  L  D  K  M  E

4561   AAGACAATCTTATGTTTTGTTAGCACGTGCTTATAAGCATCTTAATAATTATGATTGTTG   4620
       K  T  I  L  C  F  V  S  T  C  L  *  A  S  *  *  L  *  L  L
        R  Q  S  Y  V  L  L  A  R  A  Y  K  H  L  N  N  Y  D  C  C
         D  N  L  M  F  C  *  H  V  L  I  S  I  L  I  I  M  I  V  V

4621   TTTGTCTACTCTCATATCGGCTGGTATATTTAGTGTTCCTGCTGATGTGTCATTAACTTA   4680
       F  V  Y  S  H  I  G  W  Y  I  *  C  S  C  *  C  V  I  N  L
        L  S  T  L  I  S  A  G  I  F  S  V  P  A  D  V  S  L  T  Y
         C  L  L  S  Y  R  L  V  Y  L  V  F  L  L  M  C  H  *  L  T

4681   CCTTCTAGGTGTTGTTGATAAACAAGTTATCCTTGTTAGTAATAATAAAGAAGATTTTGA   4740
       P  S  R  C  C  *  *  T  S  Y  P  C  *  *  *  *  R  R  F  *
        L  L  G  V  V  D  K  Q  V  I  L  V  S  N  N  K  E  D  F  D
         F  *  V  L  L  I  N  K  L  S  L  L  V  I  I  K  K  I  L  I

4741   TATTATTCAAAAATGTCAAATTACTTCAGTTGTTGGTACTAAAGCATTGGCTGTTAGATT   4800
       Y  Y  S  K  M  S  N  Y  F  S  C  W  Y  *  S  I  G  C  *  I
        I  I  Q  K  C  Q  I  T  S  V  V  G  T  K  A  L  A  V  R  L
         L  F  K  N  V  K  L  L  Q  L  L  V  L  K  H  W  L  L  D  *

4801   AACTGCTAATGTAGGCCGTGTTATTAAATTTGAGACAGATGCATACAAACTTTTTTTGAG   4860
       N  C  *  C  R  P  C  Y  *  I  *  D  R  C  I  Q  T  F  F  E
        T  A  N  V  G  R  V  I  K  F  E  T  D  A  Y  K  L  F  L  S
         L  L  M  *  A  V  L  L  N  L  R  Q  M  H  T  N  F  F  *  V
```

FIG. 2 CONT.

```
4861   TGGTGATGATTGTTTTGTTTCAAATTCTTCTGTTATACAAGAAGTTTTATTGCTTCGTCA   4920
       W  *  *  L  F  C  F  K  F  F  C  Y  T  R  S  F  I  A  S  S
        G  D  D  C  F  V  S  N  S  S  V  I  Q  E  V  L  L  L  R  H
         V  M  I  V  L  F  Q  I  L  L  L  Y  K  K  F  Y  C  F  V  M

4921   TGATATACAATTGAATAATGACGTTCGTGATTATTTGTTGTCTAAGATGACTAGTCTTCC   4980
       *  Y  T  I  E  *  *  R  S  *  L  F  V  V  *  D  D  *  S  S
        D  I  Q  L  N  N  D  V  R  D  Y  L  L  S  K  M  T  S  L  P
         I  Y  N  *  I  M  T  F  V  I  I  C  C  L  R  *  L  V  F  L

4981   TAAAGATTGGCGTCTTATCAATAAATTTGATGTTATTAACGGTGTTAAAACTGTTAAGTA   5040
       *  R  L  A  S  Y  Q  *  I  *  C  Y  *  R  C  *  N  C  *  V
        K  D  W  R  L  I  N  K  F  D  V  I  N  G  V  K  T  V  K  Y
         K  I  G  V  L  S  I  N  L  M  L  L  T  V  L  K  L  L  S  I

5041   TTTTGAGTGTCCTAATTCTATTTATATATGTAGTCAGGGTAAAGACTTTGGTTATGTATG   5100
       F  *  V  S  *  F  Y  L  Y  M  *  S  G  *  R  L  W  L  C  M
        F  E  C  P  N  S  I  Y  I  C  S  Q  G  K  D  F  G  Y  V  C
         L  S  V  L  I  L  F  I  Y  V  V  R  V  K  T  L  V  M  Y  V

5101   TGATGGTTCTTTTTATAAAGCAACTGTTAATCAAGTTTGTGTTTTATTAGCTAAGAAGAT   5160
       *  W  F  F  L  *  S  N  C  *  S  S  L  C  F  I  S  *  E  D
        D  G  S  F  Y  K  A  T  V  N  Q  V  C  V  L  L  A  K  K  I
         M  V  L  F  I  K  Q  L  L  I  K  F  V  F  Y  *  L  R  R  *

5161   AGATGTTTTGCTTACTGTAGATGGTGTTAATTTTAAATCTATTTCTCTTACTGTAGGTGA   5220
       R  C  F  A  Y  C  R  W  C  *  F  *  I  Y  F  S  Y  C  R  *
        D  V  L  L  T  V  D  G  V  N  F  K  S  I  S  L  T  V  G  E
         M  F  C  L  L  *  M  V  L  I  L  N  L  F  L  L  L  *  V  K

5221   AGTTTTTGGTAAAATACTTGGTAATGTTTTCTGTGATGGCATTGATGTTACTAAGTTAAA   5280
       S  F  W  *  N  T  W  *  C  F  L  *  W  H  *  C  Y  *  V  K
        V  F  G  K  I  L  G  N  V  F  C  D  G  I  D  V  T  K  L  K
         F  L  V  K  Y  L  V  M  F  S  V  M  A  L  M  L  L  S  *  S

5281   GTGTAGTGATTTTTATGCCGATAAAATTTTATATCAGTATGAAAATTTGTCTTTAGCTGA   5340
       V  *  *  F  L  C  R  *  N  F  I  S  V  *  K  F  V  F  S  *
        C  S  D  F  Y  A  D  K  I  L  Y  Q  Y  E  N  L  S  L  A  D
         V  V  I  F  M  P  I  K  F  Y  I  S  M  K  I  C  L  *  L  I

5341   TATTTCTGCTGTACAAAGTTCATTTGGGTTTGATCAGCAACAATTGCTTGCTTATTATAA   5400
       Y  F  C  C  T  K  F  I  W  V  *  S  A  T  I  A  C  L  L  *
        I  S  A  V  Q  S  S  F  G  F  D  Q  Q  Q  L  L  A  Y  Y  N
         F  L  L  Y  K  V  H  L  G  L  I  S  N  N  C  L  L  I  I  I
```

FIG. 2 CONT.

```
5401   TTTTTTAACAGTATGTAAATGGTCTGTAGTTGTTAACGGTCCATTTTTTTCTTTTGAACA   5460
       F  F  N  S  M  *  M  V  C  S  C  *  R  S  I  F  F  F  *  T
        F  L  T  V  C  K  W  S  V  V  V  N  G  P  F  F  S  F  E  Q
         F  *  Q  Y  V  N  G  L  *  L  L  T  V  H  F  F  L  L  N  S

5461   GTCTCATAATAATTGTTATGTGAATGTAGCTTGTCTTATGTTGCAGCATATTAATCTTAA   5520
       V  S  *  *  L  L  C  E  C  S  L  S  Y  V  A  A  Y  *  S  *
        S  H  N  N  C  Y  V  N  V  A  C  L  M  L  Q  H  I  N  L  K
         L  I  I  I  V  M  *  M  *  L  V  L  C  C  S  I  L  I  L  N

5521   ATTTAATAAATGGCAGTGGCAGGAAGCATGGTATGAATTTCGTGCTGGCAGACCACATAG   5580
       I  *  *  M  A  V  A  G  S  M  V  *  I  S  C  W  Q  T  T  *
        F  N  K  W  Q  W  Q  E  A  W  Y  E  F  R  A  G  R  P  H  R
         L  I  N  G  S  G  R  K  H  G  M  N  F  V  L  A  D  H  I  G

5581   GTTAGTTGCTCTTGTTTTAGCTAAAGGTCATTTTAAATTTGATGAACCATCAGATGCTAC   5640
       V  S  C  S  C  F  S  *  R  S  F  *  I  *  *  T  I  R  C  Y
        L  V  A  L  V  L  A  K  G  H  F  K  F  D  E  P  S  D  A  T
         *  L  L  L  F  *  L  K  V  I  L  N  L  M  N  H  Q  M  L  L

5641   TGATTTTATTCGTGTTGTTTTGAAACAAGCTGATTTATCAGGTGCAATTTGTGAATTAGA   5700
       *  F  Y  S  C  C  F  E  T  S  *  F  I  R  C  N  L  *  I  R
        D  F  I  R  V  V  L  K  Q  A  D  L  S  G  A  I  C  E  L  E
         I  L  F  V  L  F  *  N  K  L  I  Y  Q  V  Q  F  V  N  *  N

5701   ACTTATTTGTGATTGTGGTATTAAACAAGAAAGTCGTGTTGGTGTTGATGCTGTTATGCA   5760
       T  Y  L  *  L  W  Y  *  T  R  K  S  C  W  C  *  C  C  Y  A
        L  I  C  D  C  G  I  K  Q  E  S  R  V  G  V  D  A  V  M  H
         L  F  V  I  V  V  L  N  K  K  V  V  L  V  L  M  L  L  C  I

5761   TTTTGGTACATTAGCAAAGACTGATCTTTTTAATGGTTATAAGATTGGCTGTAATTGTGC   5820
       F  W  Y  I  S  K  D  *  S  F  *  W  L  *  D  W  L  *  L  C
        F  G  T  L  A  K  T  D  L  F  N  G  Y  K  I  G  C  N  C  A
         L  V  H  *  Q  R  L  I  F  L  M  V  I  R  L  A  V  I  V  Q

5821   AGGTAGAATTGTCCATTGTACTAAATTGAATGTACCATTTTTGATTTGTTCTAATACTCC   5880
       R  *  N  C  P  L  Y  *  I  E  C  T  I  F  D  L  F  *  Y  S
        G  R  I  V  H  C  T  K  L  N  V  P  F  L  I  C  S  N  T  P
         V  E  L  S  I  V  L  N  *  M  Y  H  F  *  F  V  L  I  L  L

5881   TCTGAGTAAGGATTTACCTGATGATGTTGTTGCAGCTAACATGTTTATGGGTGTAGGTGT   5940
       S  E  *  G  F  T  *  *  C  C  C  S  *  H  V  Y  G  C  R  C
        L  S  K  D  L  P  D  D  V  V  A  A  N  M  F  M  G  V  G  V
         *  V  R  I  Y  L  M  M  L  L  Q  L  T  C  L  W  V  *  V  *
```

FIG. 2 CONT.

```
5941  AGGCCATTATACACATTTGAAATGTGGTTCACCTTACCAACATTATGATGCTTGTAGTGT  6000
      R  P  L  Y  T  F  E  M  W  F  T  L  P  T  L  *  C  L  *  C
       G  H  Y  T  H  L  K  C  G  S  P  Y  Q  H  Y  D  A  C  S  V
        A  I  I  H  I  *  N  V  V  H  L  T  N  I  M  M  L  V  V  L

6001  TAAAAAATATACAGGTGTTAGTGGTTGTTTAACTGACTGCTTGTATCTTAAAAATTTAAC  6060
      *  K  I  Y  R  C  *  W  L  F  N  *  L  L  V  S  *  K  F  N
       K  K  Y  T  G  V  S  G  C  L  T  D  C  L  Y  L  K  N  L  T
        K  N  I  Q  V  L  V  V  V  *  L  T  A  C  I  L  K  I  *  P

6061  CCAGACTTTTACATCTATGTTGACTAATTATTTTTTGGATGATGTTGAAATGGTTGCTTA  6120
      P  D  F  Y  I  Y  V  D  *  L  F  F  G  *  C  *  N  G  C  L
       Q  T  F  T  S  M  L  T  N  Y  F  L  D  D  V  E  M  V  A  Y
        R  L  L  H  L  C  *  L  I  I  F  W  M  M  L  K  W  L  L  I

6121  TAACCCTGATCTTTCACAATATTATTGTGATAATGGTAAGTATTATACAAAACCTATTAT  6180
      *  P  *  S  F  T  I  L  L  *  *  W  *  V  L  Y  K  T  Y  Y
       N  P  D  L  S  Q  Y  Y  C  D  N  G  K  Y  Y  T  K  P  I  I
        T  L  I  F  H  N  I  I  V  I  M  V  S  I  I  Q  N  L  L  *

6181  AAAGGCTCAGTTTAAACCATTTGCTAAAGTTGACGGTGTTTATACTAACTTTAAGTTAGT  6240
      K  G  S  V  *  T  I  C  *  S  *  R  C  L  Y  *  L  *  V  S
       K  A  Q  F  K  P  F  A  K  V  D  G  V  Y  T  N  F  K  L  V
        R  L  S  L  N  H  L  L  K  L  T  V  F  I  L  T  L  S  *  L

6241  TGGACATGATATTTGTGCTCAATTGAATGATAAGTTAGGTTTTAATGTAGATTTGCCGTT  6300
      W  T  *  Y  L  C  S  I  E  *  *  V  R  F  *  C  R  F  A  V
       G  H  D  I  C  A  Q  L  N  D  K  L  G  F  N  V  D  L  P  F
        D  M  I  F  V  L  N  *  M  I  S  *  V  L  M  *  I  C  R  L

6301  TGTTGAGTACAAAGTAACAGTCTGGCCTGTAGCTACTGGTGATGTTGTTTTGGCATCTGA  6360
      C  *  V  Q  S  N  S  L  A  C  S  Y  W  *  C  C  F  G  I  *
       V  E  Y  K  V  T  V  W  P  V  A  T  G  D  V  V  L  A  S  D
        L  S  T  K  *  Q  S  G  L  *  L  L  V  M  L  F  W  H  L  M

6361  TGATTTATATGTGAAACGTTATTTTAAAGGATGTGAAACTTTTGGTAAGCCTGTTATTTG  6420
      *  F  I  C  E  T  L  F  *  R  M  *  N  F  W  *  A  C  Y  L
       D  L  Y  V  K  R  Y  F  K  G  C  E  T  F  G  K  P  V  I  W
        I  Y  M  *  N  V  I  L  K  D  V  K  L  L  V  S  L  L  F  G

6421  GTTTTGTCATGATGAAGCATCATTGAATTCTCTTACTTATTTTAATAAACCTAGTTTTAA  6480
      V  L  S  *  *  S  I  I  E  F  S  Y  L  F  *  *  T  *  F  *
       F  C  H  D  E  A  S  L  N  S  L  T  Y  F  N  K  P  S  F  K
        F  V  M  M  K  H  H  *  I  L  L  L  I  L  I  N  L  V  L  N
```

FIG. 2 CONT.

```
6481   ATCTGAAAATAGATATAGTGTTTTGTCTGTTGATTCTGTATCTGAGGAGTCACAAGGTAA   6540
       I  *  K  *  I  *  C  F  V  C  *  F  C  I  *  G  V  T  R  *
        S  E  N  R  Y  S  V  L  S  V  D  S  V  S  E  E  S  Q  G  N
         L  K  I  D  I  V  F  C  L  L  I  L  Y  L  R  S  H  K  V  M

6541   TGTGGTTACTTCTGTTATGGAATCGCAGATTAGTACTAAAGAGGTTAAGTTAAAGGGTGT   6600
       C  G  Y  F  C  Y  G  I  A  D  *  Y  *  R  G  *  V  K  G  C
        V  V  T  S  V  M  E  S  Q  I  S  T  K  E  V  K  L  K  G  V
         W  L  L  L  L  W  N  R  R  L  V  L  K  R  L  S  *  R  V  L

6601   TAGAAAGACTGTTAAAATAGAAGATGCTATTATTGTTAATGATGAAAATAGTTCTATTAA   6660
       *  K  D  C  *  N  R  R  C  Y  Y  C  *  *  *  K  *  F  Y  *
        R  K  T  V  K  I  E  D  A  I  I  V  N  D  E  N  S  S  I  K
         E  R  L  L  K  *  K  M  L  L  L  L  M  M  K  I  V  L  L  R

6661   GGTTGTTAAAAGTTTATCTTTAGTTGATGTTTGGGATATGTATTTGACAGGTTGTGATTA   6720
       G  C  *  K  F  I  F  S  *  C  L  G  Y  V  F  D  R  L  *  L
        V  V  K  S  L  S  L  V  D  V  W  D  M  Y  L  T  G  C  D  Y
         L  L  K  V  Y  L  *  L  M  F  G  I  C  I  *  Q  V  V  I  M

6721   TGTTGTTTGGGTTGCTAATGAATTGTCACGCCTAGTTAAATCACCAACAGTTAGGGAATA   6780
       C  C  L  G  C  *  *  I  V  T  P  S  *  I  T  N  S  *  G  I
        V  V  W  V  A  N  E  L  S  R  L  V  K  S  P  T  V  R  E  Y
         L  F  G  L  L  M  N  C  H  A  *  L  N  H  Q  Q  L  G  N  I

6781   TATACGATATGGTATTAAACCTATTACTATACCTATAGATTTGTTATGTTTAAGAGATGA   6840
       Y  T  I  W  Y  *  T  Y  Y  Y  T  Y  R  F  V  M  F  K  R  *
        I  R  Y  G  I  K  P  I  T  I  P  I  D  L  L  C  L  R  D  D
         Y  D  M  V  L  N  L  L  L  Y  L  *  I  C  Y  V  *  E  M  I

6841   TAATCAAACTCTTTTAGTTCCTAAAATTTTTAAAGCAAGAGCTATAGAATTTTATGGTTT   6900
       *  S  N  S  F  S  S  *  N  F  *  S  K  S  Y  R  I  L  W  F
        N  Q  T  L  L  V  P  K  I  F  K  A  R  A  I  E  F  Y  G  F
         I  K  L  F  *  F  L  K  F  L  K  Q  E  L  *  N  F  M  V  F

6901   TTTGAAGTGGTTGTTTATTTATGTTTTTAGTTTATTACATTTTACAAATGATAAAACCAT   6960
       F  E  V  V  V  Y  L  C  F  *  F  I  T  F  Y  K  *  *  N  H
        L  K  W  L  F  I  Y  V  F  S  L  L  H  F  T  N  D  K  T  I
         *  S  G  C  L  F  M  F  L  V  Y  Y  I  L  Q  M  I  K  P  F

6961   TTTTTATACTACAGAAATAGCTTCTAAGTTTACTTTTAATTTGTTTTGTTTGGCTCTTAA   7020
       F  L  Y  Y  R  N  S  F  *  V  Y  F  *  F  V  L  F  G  S  *
        F  Y  T  T  E  I  A  S  K  F  T  F  N  L  F  C  L  A  L  K
         F  I  L  Q  K  *  L  L  S  L  L  L  I  C  F  V  W  L  L  K
```

FIG. 2 CONT.

```
7021    AAATGCTTTTCAGACATTTAGATGGAGTATATTTATAAAAGGTTTTCTTGTTGTAGCCAC    7080
        K  C  F  S  D  I  *  M  E  Y  I  Y  K  R  F  S  C  C  S  H
         N  A  F  Q  T  F  R  W  S  I  F  I  K  G  F  L  V  V  A  T
          M  L  F  R  H  L  D  G  V  Y  L  *  K  V  F  L  L  *  P  L

7081    TGTGTTTTTGTTTTGGTTTAATTTTTTGTATATAAATGTTATTTTTAGTGACTTTTATCT    7140
        C  V  F  V  L  V  *  F  F  V  Y  K  C  Y  F  *  *  L  L  S
         V  F  L  F  W  F  N  F  L  Y  I  N  V  I  F  S  D  F  Y  L
          C  F  C  F  G  L  I  F  C  I  *  M  L  F  L  V  T  F  I  F

7141    TCCTAATATTAGTGTTTTTCCTATTTTTGTGGGAAGAATTGTTATGTGGATAAAGGCTAC    7200
        S  *  Y  *  C  F  S  Y  F  C  G  K  N  C  Y  V  D  K  G  Y
         P  N  I  S  V  F  P  I  F  V  G  R  I  V  M  W  I  K  A  T
          L  I  L  V  F  F  L  F  L  W  E  E  L  L  C  G  *  R  L  L

7201    TTTTGGTTTGGTTACAATTTGTGATTTTTATTCTAAGTTAGGTGTAGGTTTTACAAGTCA    7260
        F  W  F  G  Y  N  L  *  F  L  F  *  V  R  C  R  F  Y  K  S
         F  G  L  V  T  I  C  D  F  Y  S  K  L  G  V  G  F  T  S  H
          L  V  W  L  Q  F  V  I  F  I  L  S  *  V  *  V  L  Q  V  I

7261    TTTTTGTAATGGTAGTTTTATATGTGAATTGTGTCATTCTGGTTTTGATATGTTGGATAC    7320
        F  L  *  W  *  F  Y  M  *  I  V  S  F  W  F  *  Y  V  G  Y
         F  C  N  G  S  F  I  C  E  L  C  H  S  G  F  D  M  L  D  T
          F  V  M  V  V  L  Y  V  N  C  V  I  L  V  L  I  C  W  I  H

7321    ATATGCAGCTATAGATTTTGTTCAGTATGAAGTAGATAGACGTGTTTTATTTGATTATGT    7380
        I  C  S  Y  R  F  C  S  V  *  S  R  *  T  C  F  I  *  L  C
         Y  A  A  I  D  F  V  Q  Y  E  V  D  R  R  V  L  F  D  Y  V
          M  Q  L  *  I  L  F  S  M  K  *  I  D  V  F  Y  L  I  M  L

7381    TAGTTTAGTCAAATTAATTGTTGAACTCGTTATTGGTTATTCATTATACACAGTATGGTT    7440
        *  F  S  Q  I  N  C  *  T  R  Y  W  L  F  I  I  H  S  M  V
         S  L  V  K  L  I  V  E  L  V  I  G  Y  S  L  Y  T  V  W  F
          V  *  S  N  *  L  L  N  S  L  L  V  I  H  Y  T  Q  Y  G  F

7441    TTATCCATTATTTTGTCTTATTGGTTTACAATTATTTACTACATGGTTGCCTGATTTGTT    7500
        L  S  I  I  L  S  Y  W  F  T  I  I  Y  Y  M  V  A  *  F  V
         Y  P  L  F  C  L  I  G  L  Q  L  F  T  T  W  L  P  D  L  F
          I  H  Y  F  V  L  L  V  Y  N  Y  L  L  H  G  C  L  I  C  L

7501    TATGTTAGAAACTATGCATTGGTTGATTAGATTTATTGTATTTGTAGCTAATATGTTACC    7560
        Y  V  R  N  Y  A  L  V  D  *  I  Y  C  I  C  S  *  Y  V  T
         M  L  E  T  M  H  W  L  I  R  F  I  V  F  V  A  N  M  L  P
          C  *  K  L  C  I  G  *  L  D  L  L  Y  L  *  L  I  C  Y  L
```

FIG. 2 CONT.

```
7561   TGCTTTTGTCTTGTTGCGGTTTTATATAGTTGTTACTGCTATGTATAAAGTAGTTGGTTT   7620
       C  F  C  L  V  A  V  L  Y  S  C  Y  C  Y  V  *  S  S  W  F
        A  F  V  L  L  R  F  Y  I  V  V  T  A  M  Y  K  V  V  G  F
         L  L  S  C  C  G  F  I  *  L  L  L  L  C  I  K  *  L  V  L

7621   TATTAGGCATATTGTCTATGGTTGTAATAAAGCTGGTTGTTTATTTTGTTATAAACGAAA   7680
       Y  *  A  Y  C  L  W  L  *  *  S  W  L  F  I  L  L  *  T  K
        I  R  H  I  V  Y  G  C  N  K  A  G  C  L  F  C  Y  K  R  N
         L  G  I  L  S  M  V  V  I  K  L  V  V  Y  F  V  I  N  E  I

7681   TTGTAGTGTTCGTGTTAAGTGTAGTACTATTGTTGGTGGTGTAATTCGTTATTATGATAT   7740
       L  *  C  S  C  *  V  *  Y  Y  C  W  W  C  N  S  L  L  *  Y
        C  S  V  R  V  K  C  S  T  I  V  G  G  V  I  R  Y  Y  D  I
         V  V  F  V  L  S  V  V  L  L  L  V  V  *  F  V  I  M  I  L

7741   TACTGCTAATGGTGGTACTGGTTTTTGTGTTAAACATCAATGGAATTGTTTTAATTGCCA   7800
       Y  C  *  W  W  Y  W  F  L  C  *  T  S  M  E  L  F  *  L  P
        T  A  N  G  G  T  G  F  C  V  K  H  Q  W  N  C  F  N  C  H
         L  L  M  V  V  L  V  F  V  L  N  I  N  G  I  V  L  I  A  I

7801   TTCTTTTAAACCAGGTAACACTTTTATAACTGTAGAAGCTGCTATAGAACTTTCTAAAGA   7860
       F  F  *  T  R  *  H  F  Y  N  C  R  S  C  Y  R  T  F  *  R
        S  F  K  P  G  N  T  F  I  T  V  E  A  A  I  E  L  S  K  E
         L  L  N  Q  V  T  L  L  *  L  *  K  L  L  *  N  F  L  K  S

7861   GCTTAAACGACCTGTAAATCCAACTGATGCTTCACATTATGTAGTTACTGATATTAAGCA   7920
       A  *  T  T  C  K  S  N  *  C  F  T  L  C  S  Y  *  Y  *  A
        L  K  R  P  V  N  P  T  D  A  S  H  Y  V  V  T  D  I  K  Q
         L  N  D  L  *  I  Q  L  M  L  H  I  M  *  L  L  I  L  S  K

7921   AGTTGGTTGTATGATGCGTTTGTTCTATGATAGAGATGGACAGCGTGTTTACGATGATGT   7980
       S  W  L  Y  D  A  F  V  L  *  *  R  W  T  A  C  L  R  *  C
        V  G  C  M  M  R  L  F  Y  D  R  D  G  Q  R  V  Y  D  D  V
         L  V  V  *  C  V  C  S  M  I  E  M  D  S  V  F  T  M  M  L

7981   TGATGCTAGTTTATTTGTAGATATTAATAATCTGTTACATTCTAAAGTTAAAGTTGTTCC   8040
       *  C  *  F  I  C  R  Y  *  *  S  V  T  F  *  S  *  S  C  S
        D  A  S  L  F  V  D  I  N  N  L  L  H  S  K  V  K  V  V  P
         M  L  V  Y  L  *  I  L  I  I  C  Y  I  L  K  L  K  L  F  L

8041   TAATTTGTATGTAGTTGTAGTAGAGAGTGATGCTGATAGAGCTAATTTTCTGAATGCTGT   8100
       *  F  V  C  S  C  S  R  E  *  C  *  *  S  *  F  S  E  C  C
        N  L  Y  V  V  V  V  E  S  D  A  D  R  A  N  F  L  N  A  V
         I  C  M  *  L  *  *  R  V  M  L  I  E  L  I  F  *  M  L  L
```

FIG. 2 CONT.

```
8101  TGTGTTTTATGCACAATCATTGTATAGGCCTATATTACTTGTAGACAAAAAGTTAATTAC  8160
      C V L C T I I V * A Y I T C R Q K V N Y
       V F Y A Q S L Y R P I L L V D K K L I T
        C F M H N H C I G L Y Y L * T K S * L L

8161  TACAGCTTGTAATGGTATCTCTGTAACCCAGACTATGTTTGATGTTTATGTTGATACTTT  8220
      Y S L * W Y L C N P D Y V * C L C * Y F
       T A C N G I S V T Q T M F D V Y V D T F
        Q L V M V S L * P R L C L M F M L I L L

8221  TATGTCTCATTTTGATGTTGATAGAAAGAGTTTTAATAATTTTGTTAACATTGCTCATGC  8280
      Y V S F * C * * K E F * * F C * H C S C
       M S H F D V D R K S F N N F V N I A H A
        C L I L M L I E R V L I I L L T L L M L

8281  TTCTCTTAGAGAGGGTGTGCAATTAGAAAAGGTTTTAGATACTTTTGTGGGATGTGTACG  8340
      F S * R G C A I R K G F R Y F C G M C T
       S L R E G V Q L E K V L D T F V G C V R
        L L E R V C N * K R F * I L L W D V Y V

8341  TAAATGTTGTTCCATTGATTCAGATGTTGAAACAAGATTTATTACTAAATCTATGATATC  8400
      * M L F H * F R C * N K I Y Y * I Y D I
       K C C S I D S D V E T R F I T K S M I S
        N V V P L I Q M L K Q D L L L N L * Y L

8401  TGCAGTAGCTGCTGGTTTGGAATTTACTGATGAAAATTATAACAATTTGGTACCTACATA  8460
      C S S C W F G I Y * * K L * Q F G T Y I
       A V A A G L E F T D E N Y N N L V P T Y
        Q * L L V W N L L M K I I T I W Y L H I

8461  TTTAAAGAGTGATAATATTGTAGCTGCTGATTTAGGTGTTCTTATACAGAATGGTGCTAA  8520
      F K E * * Y C S C * F R C S Y T E W C *
       L K S D N I V A A D L G V L I Q N G A K
        * R V I I L * L L I * V F L Y R M V L S

8521  GCATGTACAGGGTAATGTTGCTAAGGCAGCTAATATTTCTTGTATATGGTTTATTGATGC  8580
      A C T G * C C * G S * Y F L Y M V Y * C
       H V Q G N V A K A A N I S C I W F I D A
        M Y R V M L L R Q L I F L V Y G L L M L

8581  TTTTAATCAACTTACTGCTGATTTACAGCATAAATTAAAAAAAGCATGTGTTAAAACTGG  8640
      F * S T Y C * F T A * I K K S M C * N W
       F N Q L T A D L Q H K L K K A C V K T G
        L I N L L L I Y S I N * K K H V L K L A
```

FIG. 2 CONT.

```
8641   CTTGAAGTTAAAATTGACTTTTAATAAGCAAGAGGCAAGTGTCCCTATTCTTACAACACC   8700
       L  E  V  K  I  D  F  *  *  A  R  G  K  C  P  Y  S  Y  N  T
        L  K  L  K  L  T  F  N  K  Q  E  A  S  V  P  I  L  T  T  P
         *  S  *  N  *  L  L  I  S  K  R  Q  V  S  L  F  L  Q  H  P

8701   CTTTTCACTTAAAGGAGGTGTTGTATTGAGTAATTTGTTATATATATTATTTTTTGTTAG   8760
       L  F  T  *  R  R  C  C  I  E  *  F  V  I  Y  I  I  F  C  *
        F  S  L  K  G  G  V  V  L  S  N  L  L  Y  I  L  F  F  V  S
         F  H  L  K  E  V  L  Y  *  V  I  C  Y  I  Y  Y  F  L  L  V

8761   TTTAATCTGTTTTATATTATTGTGGGCTTTATTGCCTACATATAGTGTTTATAAGTCTGA   8820
       F  N  L  F  Y  I  I  V  G  F  I  A  Y  I  *  C  L  *  V  *
        L  I  C  F  I  L  L  W  A  L  L  P  T  Y  S  V  Y  K  S  D
         *  S  V  L  Y  Y  C  G  L  Y  C  L  H  I  V  F  I  S  L  I

8821   TATTCATTTGCCTGCTTATGCTAGTTTTAAAGTTATTGATAATGGTGTTGTTAGAGATAT   8880
       Y  S  F  A  C  L  C  *  F  *  S  Y  *  *  W  C  C  *  R  Y
        I  H  L  P  A  Y  A  S  F  K  V  I  D  N  G  V  V  R  D  I
         F  I  C  L  L  M  L  V  L  K  L  L  I  M  V  L  L  E  I  F

8881   TTCAGTTAATGATTTATGTTTTGCTAATAAATTTTTCCAATTTGATCAATGGTATGAGTC   8940
       F  S  *  *  F  M  F  C  *  *  I  F  P  I  *  S  M  V  *  V
        S  V  N  D  L  C  F  A  N  K  F  F  Q  F  D  Q  W  Y  E  S
         Q  L  M  I  Y  V  L  L  I  N  F  S  N  L  I  N  G  M  S  P

8941   CACTTTTGGGTCTGTTTACTATCATAATTCTATGGATTGCCCTATTGTAGTGGCAGTTAT   9000
       H  F  W  V  C  L  L  S  *  F  Y  G  L  P  Y  C  S  G  S  Y
        T  F  G  S  V  Y  Y  H  N  S  M  D  C  P  I  V  V  A  V  M
         L  L  G  L  F  T  I  I  I  L  W  I  A  L  L  *  W  Q  L  W

9001   GGATGAAGATATCGGTTCTACTATGTTTAATGTTCCTACTAAAGTTTTGAGACATGGCTT   9060
       G  *  R  Y  R  F  Y  Y  V  *  C  S  Y  *  S  F  E  T  W  L
        D  E  D  I  G  S  T  M  F  N  V  P  T  K  V  L  R  H  G  F
         M  K  I  S  V  L  L  C  L  M  F  L  L  K  F  *  D  M  A  F

9061   TCATGTTTTACATTTTTTAACTTATGCATTTGCTAGTGATAGTGTTCAGTGCTATACACC   9120
       S  C  F  T  F  F  N  L  C  I  C  *  *  *  C  S  V  L  Y  T
        H  V  L  H  F  L  T  Y  A  F  A  S  D  S  V  Q  C  Y  T  P
         M  F  Y  I  F  *  L  M  H  L  L  V  I  V  F  S  A  I  H  H

9121   ACATATTCAGATTTCTTATAATGATTTTTATGCTAGTGGTTGTGTTTTATCATCTTTGTG   9180
       T  Y  S  D  F  L  *  *  F  L  C  *  W  L  C  F  I  I  F  V
        H  I  Q  I  S  Y  N  D  F  Y  A  S  G  C  V  L  S  S  L  C
         I  F  R  F  L  I  M  I  F  M  L  V  V  V  F  Y  H  L  C  V
```

FIG. 2 CONT.

```
9181   TACTATGTTTAAAAGAGGTGATGGTACACCACATCCTTATTGTTATTCAGATGGTGTTAT   9240
       Y  Y  V  *  K  R  *  W  Y  T  T  S  L  L  L  F  R  W  C  Y
        T  M  F  K  R  G  D  G  T  P  H  P  Y  C  Y  S  D  G  V  M
         L  C  L  K  E  V  M  V  H  H  I  L  I  V  I  Q  M  V  L  *

9241   GAAGAATGCTTCTTTGTATACATCTTTGGTTCCACATACACGTTATAGCCTTGCTAATTC   9300
       E  E  C  F  F  V  Y  I  F  G  S  T  Y  T  L  *  P  C  *  F
        K  N  A  S  L  Y  T  S  L  V  P  H  T  R  Y  S  L  A  N  S
         R  M  L  L  C  I  H  L  W  F  H  I  H  V  I  A  L  L  I  L

9301   TAATGGTTTTATAAGATTTCCTGATGTTATTAGTGAAGGTATTGTACGTATTGTAAGAAC   9360
       *  W  F  Y  K  I  S  *  C  Y  *  *  R  Y  C  T  Y  C  K  N
        N  G  F  I  R  F  P  D  V  I  S  E  G  I  V  R  I  V  R  T
         M  V  L  *  D  F  L  M  L  L  V  K  V  L  Y  V  L  *  E  R

9361   GCGCTCTATGACTTATTGTAGAGTGGGTGCATGTGAATACGCCGAAGAGGGTATATGTTT   9420
       A  L  Y  D  L  L  *  S  G  C  M  *  I  R  R  R  G  Y  M  F
        R  S  M  T  Y  C  R  V  G  A  C  E  Y  A  E  E  G  I  C  F
         A  L  *  L  I  V  E  W  V  H  V  N  T  P  K  R  V  Y  V  L

9421   TAATTTTAATAGTTCCTGGGTTTTGAATAATGATTATTATAGAAGTATGCCTGGAACTTT   9480
       *  F  *  *  F  L  G  F  E  *  *  L  L  *  K  Y  A  W  N  F
        N  F  N  S  S  W  V  L  N  N  D  Y  Y  R  S  M  P  G  T  F
         I  L  I  V  P  G  F  *  I  M  I  I  I  E  V  C  L  E  L  F

9481   TTGTGGTAGAGATCTTTTTGATTTGTTTTATCAATTTTTTAGTAGTTTAATTCGTCCTAT   9540
       L  W  *  R  S  F  *  F  V  L  S  I  F  *  *  F  N  S  S  Y
        C  G  R  D  L  F  D  L  F  Y  Q  F  F  S  S  L  I  R  P  I
         V  V  E  I  F  L  I  C  F  I  N  F  L  V  V  *  F  V  L  *

9541   AGATTTCTTTTCTCTTACTGCTAGTTCTATTTTTGGAGCTATATTGGCTATAGTTGTTGT   9600
       R  F  L  F  S  Y  C  *  F  Y  F  W  S  Y  I  G  Y  S  C  C
        D  F  F  S  L  T  A  S  S  I  F  G  A  I  L  A  I  V  V  V
         I  S  F  L  L  L  L  V  L  F  L  E  L  Y  W  L  *  L  L  S

9601   CTTGGTTTTTTATTATTTAATAAAACTTAAGCGTGCTTTTGGAGATTATACTAGTGTTGT   9660
       L  G  F  L  L  F  N  K  T  *  A  C  F  W  R  L  Y  *  C  C
        L  V  F  Y  Y  L  I  K  L  K  R  A  F  G  D  Y  T  S  V  V
         W  F  F  I  I  *  *  N  L  S  V  L  L  E  I  I  L  V  L  *

9661   AGTTATAAATGTTGTTGTTTGGTGTATTAATTTTCTTATGCTTTTTGTTTTTCAAGTTTA   9720
       S  Y  K  C  C  C  L  V  Y  *  F  S  Y  A  F  C  F  S  S  L
        V  I  N  V  V  V  W  C  I  N  F  L  M  L  F  V  F  Q  V  Y
         L  *  M  L  L  F  G  V  L  I  F  L  C  F  L  F  F  K  F  I
```

FIG. 2 CONT.

```
9721   TCCTATTTGTGCATGTGTTTATGCTTGTTTTTATTTTTATGTAACATTGTATTTTCCTTC   9780
       S  Y  L  C  M  C  L  C  L  F  L  F  L  C  N  I  V  F  S  F
        P  I  C  A  C  V  Y  A  C  F  Y  F  Y  V  T  L  Y  F  P  S
         L  F  V  H  V  F  M  L  V  F  I  F  M  *  H  C  I  F  L  L

9781   TGAAATTAGTGTAATTATGCATTTGCAATGGATTGTTATGTATGGTGCTATAATGCCTTT   9840
       *  N  *  C  N  Y  A  F  A  M  D  C  Y  V  W  C  Y  N  A  F
        E  I  S  V  I  M  H  L  Q  W  I  V  M  Y  G  A  I  M  P  F
         K  L  V  *  L  C  I  C  N  G  L  L  C  M  V  L  *  C  L  F

9841   TTGGTTTTGTGTCACATATGTAGCTATGGTTATTGCAAACCATGTTTTATGGTTATTTTC   9900
       L  V  L  C  H  I  C  S  Y  G  Y  C  K  P  C  F  M  V  I  F
        W  F  C  V  T  Y  V  A  M  V  I  A  N  H  V  L  W  L  F  S
         G  F  V  S  H  M  *  L  W  L  L  Q  T  M  F  Y  G  Y  F  H

9901   ATATTGTAGGAAAATTGGTGTTAATGTATGTAGTGATAGTACATTTGAAGAAACATCTCT   9960
       I  L  *  E  N  W  C  *  C  M  *  *  *  Y  I  *  R  N  I  S
        Y  C  R  K  I  G  V  N  V  C  S  D  S  T  F  E  E  T  S  L
         I  V  G  K  L  V  L  M  Y  V  V  I  V  H  L  K  K  H  L  L

9961   TACTACTTTTATGATTACTAAAGATTCTTATTGTAGATTAAAGAATTCTGTTTCTGATGT   10020
       Y  Y  F  Y  D  Y  *  R  F  L  L  *  I  K  E  F  C  F  *  C
        T  T  F  M  I  T  K  D  S  Y  C  R  L  K  N  S  V  S  D  V
         L  L  L  *  L  L  K  I  L  I  V  D  *  R  I  L  F  L  M  L

10021  TGCCTACAATAGATATTTGAGTTTGTATAATAAGTATCGTTACTATAGTGGTAAAATGGA   10080
       C  L  Q  *  I  F  E  F  V  *  *  V  S  L  L  *  W  *  N  G
        A  Y  N  R  Y  L  S  L  Y  N  K  Y  R  Y  Y  S  G  K  M  D
         P  T  I  D  I  *  V  C  I  I  S  I  V  T  I  V  V  K  W  I

10081  TACTGCTGCCTATAGAGAAGCGGCGTGTTCTCAGTTAGCTAAAGCTATGGAAACATTTAA   10140
       Y  C  C  L  *  R  S  G  V  F  S  V  S  *  S  Y  G  N  I  *
        T  A  A  Y  R  E  A  A  C  S  Q  L  A  K  A  M  E  T  F  N
         L  L  P  I  E  K  R  R  V  L  S  *  L  K  L  W  K  H  L  I

10141  TCACAATAATGGTAATGATGTCTTATACCAACCTCCTACAGCATCTGTTTCTACATCTTT   10200
       S  Q  *  W  *  *  C  L  I  P  T  S  Y  S  I  C  F  Y  I  F
        H  N  N  G  N  D  V  L  Y  Q  P  P  T  A  S  V  S  T  S  F
         T  I  M  V  M  M  S  Y  T  N  L  L  Q  H  L  F  L  H  L  F

10201  TTTGCAATCAGGTATTGTAAAGATGGTATCTCCTACGTCAAAAATTGAACCTTGTATTGT   10260
       F  A  I  R  Y  C  K  D  G  I  S  Y  V  K  N  *  T  L  Y  C
        L  Q  S  G  I  V  K  M  V  S  P  T  S  K  I  E  P  C  I  V
         C  N  Q  V  L  *  R  W  Y  L  L  R  Q  K  L  N  L  V  L  L
```

FIG. 2 CONT.

```
10261  TAGTGTTACTTATGGTAGTATGACTTTGAATGGTTTATGGTTAGATGACAAAGTTTATTG  10320
       *  C  Y  L  W  *  Y  D  F  E  W  F  M  V  R  *  Q  S  L  L
        S  V  T  Y  G  S  M  T  L  N  G  L  W  L  D  D  K  V  Y  C
         V  L  L  M  V  V  *  L  *  M  V  Y  G  *  M  T  K  F  I  V

10321  TCCTCGTCATGTTATATGTTCATCCTCTAATATGAACGAACCTGATTATTCTGCCTTATT  10380
       S  S  S  C  Y  M  F  I  L  *  Y  E  R  T  *  L  F  C  L  I
        P  R  H  V  I  C  S  S  S  N  M  N  E  P  D  Y  S  A  L  L
         L  V  M  L  Y  V  H  P  L  I  *  T  N  L  I  I  L  P  Y  C

10381  GTGTAGAGTTACTCTAGGTGATTTTACTATAATGTCTGGTCGGATGAGTTTAACAGTTGT  10440
       V  *  S  Y  S  R  *  F  Y  Y  N  V  W  S  D  E  F  N  S  C
        C  R  V  T  L  G  D  F  T  I  M  S  G  R  M  S  L  T  V  V
         V  E  L  L  *  V  I  L  L  *  C  L  V  G  *  V  *  Q  L  C

10441  GTCTTACCAGATGCAGGGCTGTCAACTTGTTTTGACAGTCTCTTTACAAAATCCTTACAC  10500
       V  L  P  D  A  G  L  S  T  C  F  D  S  L  F  T  K  S  L  H
        S  Y  Q  M  Q  G  C  Q  L  V  L  T  V  S  L  Q  N  P  Y  T
         L  T  R  C  R  A  V  N  L  F  *  Q  S  L  Y  K  I  L  T  L

10501  TCCAAAATATACTTTTGGTAATGTTAAACCTGGTGAAACTTTTACTGTTTTAGCTGCGTA  10560
       S  K  I  Y  F  W  *  C  *  T  W  *  N  F  Y  C  F  S  C  V
        P  K  Y  T  F  G  N  V  K  P  G  E  T  F  T  V  L  A  A  Y
         Q  N  I  L  L  V  M  L  N  L  V  K  L  L  L  F  *  L  R  I

10561  TAATGGCCGACCACAAGGGGCATTTCATGTTACTATGCGTAGTAGTTATACTATTAAAGG  10620
       *  W  P  T  T  R  G  I  S  C  Y  Y  A  *  *  L  Y  Y  *  R
        N  G  R  P  Q  G  A  F  H  V  T  M  R  S  S  Y  T  I  K  G
         M  A  D  H  K  G  H  F  M  L  L  C  V  V  V  I  L  L  K  V

10621  TTCTTTTTTGTGTGGGTCATGTGGATCTGTTGGTTATGTATTAACAGGTGATAGTGTTAA  10680
       F  F  F  V  W  V  M  W  I  C  W  L  C  I  N  R  *  *  C  *
        S  F  L  C  G  S  C  G  S  V  G  Y  V  L  T  G  D  S  V  K
         L  F  C  V  G  H  V  D  L  L  V  M  Y  *  Q  V  I  V  L  S

10681  GTTTGTATATATGCATCAATTAGAGCTCAGTACTGGTTGTCACACTGGCACTGATTTTAC  10740
       V  C  I  Y  A  S  I  R  A  Q  Y  W  L  S  H  W  H  *  F  Y
        F  V  Y  M  H  Q  L  E  L  S  T  G  C  H  T  G  T  D  F  T
         L  Y  I  C  I  N  *  S  S  V  L  V  V  T  L  A  L  I  L  L

10741  TGGTAATTTTTATGGTCCATATAGAGATGCTCAAGTTGTACAGTTGCCAGTTAAGGACTA  10800
       W  *  F  L  W  S  I  *  R  C  S  S  C  T  V  A  S  *  G  L
        G  N  F  Y  G  P  Y  R  D  A  Q  V  V  Q  L  P  V  K  D  Y
         V  I  F  M  V  H  I  E  M  L  K  L  Y  S  C  Q  L  R  T  T
```

FIG. 2 CONT.

```
10801   CGTCCAGACTGTTAATGTTATTGCTTGGCTCTATGCAGCTATACTTAATAATTGTGCTTG   10860
        R  P  D  C  *  C  Y  C  L  A  L  C  S  Y  T  *  *  L  C  L
         V  Q  T  V  N  V  I  A  W  L  Y  A  A  I  L  N  N  C  A  W
          S  R  L  L  M  L  L  L  G  S  M  Q  L  Y  L  I  I  V  L  G

10861   GTTTGTACAAAATGATGTTTGTTCTACTGAAGATTTTAATGTTTGGGCTATGGCAAATGG   10920
        V  C  T  K  *  C  L  F  Y  *  R  F  *  C  L  G  Y  G  K  W
         F  V  Q  N  D  V  C  S  T  E  D  F  N  V  W  A  M  A  N  G
          L  Y  K  M  M  F  V  L  L  K  I  L  M  F  G  L  W  Q  M  V

10921   TTTTAGCCAAGTAAAAGCAGATCTTGTCTTAGATGCTTTGGCTTCAATGACAGGTGTTTC   10980
        F  *  P  S  K  S  R  S  C  L  R  C  F  G  F  N  D  R  C  F
         F  S  Q  V  K  A  D  L  V  L  D  A  L  A  S  M  T  G  V  S
          L  A  K  *  K  Q  I  L  S  *  M  L  W  L  Q  *  Q  V  F  L

10981   TATTGAAACTTTATTGGCTGCTATTAAGCGTCTATATATGGGATTTCAAGGTCGTCAAAT   11040
        Y  *  N  F  I  G  C  Y  *  A  S  I  Y  G  I  S  R  S  S  N
         I  E  T  L  L  A  A  I  K  R  L  Y  M  G  F  Q  G  R  Q  I
          L  K  L  Y  W  L  L  L  S  V  Y  I  W  D  F  K  V  V  K  Y

11041   ACTAGGAAGTTGTACTTTTGAAGATGAATTGGCACCTTCTGACGTTTATCAACAATTGGC   11100
        T  R  K  L  Y  F  *  R  *  I  G  T  F  *  R  L  S  T  I  G
         L  G  S  C  T  F  E  D  E  L  A  P  S  D  V  Y  Q  Q  L  A
          *  E  V  V  L  L  K  M  N  W  H  L  L  T  F  I  N  N  W  L

11101   TGGTGTTAAATTGCAATCTAAAACAAAAAGATTTATTAAAGAAACAATTTATTGGATTTT   11160
        W  C  *  I  A  I  *  N  K  K  I  Y  *  R  N  N  L  L  D  F
         G  V  K  L  Q  S  K  T  K  R  F  I  K  E  T  I  Y  W  I  L
          V  L  N  C  N  L  K  Q  K  D  L  L  K  K  Q  F  I  G  F  *

11161   GATATCTACATTTTTGTTTAGTTGTATAATTTCTGCATTTGTTAAATGGACTATATTTAT   11220
        D  I  Y  I  F  V  *  L  Y  N  F  C  I  C  *  M  D  Y  I  Y
         I  S  T  F  L  F  S  C  I  I  S  A  F  V  K  W  T  I  F  M
          Y  L  H  F  C  L  V  V  *  F  L  H  L  L  N  G  L  Y  L  C

11221   GTATATTAATACACATATGATTGGTGTTACATTATGTGTACTTTGTTTTGTTAGTTTTAT   11280
        V  Y  *  Y  T  Y  D  W  C  Y  I  M  C  T  L  F  C  *  F  Y
         Y  I  N  T  H  M  I  G  V  T  L  C  V  L  C  F  V  S  F  M
          I  L  I  H  I  *  L  V  L  H  Y  V  Y  F  V  L  L  V  L  *

11281   GATGTTACTAGTTAAACATAAGCATTTTTATTTGACTATGTATATAATTCCTGTACTCTG   11340
        D  V  T  S  *  T  *  A  F  L  F  D  Y  V  Y  N  S  C  T  L
         M  L  L  V  K  H  K  H  F  Y  L  T  M  Y  I  I  P  V  L  C
          C  Y  *  L  N  I  S  I  F  I  *  L  C  I  *  F  L  Y  S  V
```

FIG. 2 CONT.

```
11341  TACCTTGTTTTATGTAAATTATTTAGTTGTTTATAAGGAAGGTTTTAGAGGTTTTACTTA  11400
       Y  L  V  L  C  K  L  F  S  C  L  *  G  R  F  *  R  F  Y  L
        T  L  F  Y  V  N  Y  L  V  V  Y  K  E  G  F  R  G  F  T  Y
         P  C  F  M  *  I  I  *  L  F  I  R  K  V  L  E  V  L  L  M

11401  TGTCTGGCTCTCATATTTTGTTCCTGCTGTGAATTTTACTTATGTTTATGAAGTATTTTA  11460
       C  L  A  L  I  F  C  S  C  C  E  F  Y  L  C  L  *  S  I  L
        V  W  L  S  Y  F  V  P  A  V  N  F  T  Y  V  Y  E  V  F  Y
         S  G  S  H  I  L  F  L  L  *  I  L  L  M  F  M  K  Y  F  M

11461  TGGTTGTATTTTATGTGTTTTTGCTATTTTTATAACTATGCATAGTATTAATCATGACAT  11520
       W  L  Y  F  M  C  F  C  Y  F  Y  N  Y  A  *  Y  *  S  *  H
        G  C  I  L  C  V  F  A  I  F  I  T  M  H  S  I  N  H  D  I
         V  V  F  Y  V  F  L  L  F  L  *  L  C  I  V  L  I  M  T  F

11521  TTTTTCTTTGATGTTTTTGGTTGGTAGAATAGTTACTTTAATTTCTATGTGGTATTTTGG  11580
       F  F  F  D  V  F  G  W  *  N  S  Y  F  N  F  Y  V  V  F  W
        F  S  L  M  F  L  V  G  R  I  V  T  L  I  S  M  W  Y  F  G
         F  L  *  C  F  W  L  V  E  *  L  L  *  F  L  C  G  I  L  G

11581  GTCGAATTTAGAAGAGGATGTTTTGTTATTTATTACAGCCTTTTTAGGTACTTATACATG  11640
       V  E  F  R  R  G  C  F  V  I  Y  Y  S  L  F  R  Y  L  Y  M
        S  N  L  E  E  D  V  L  L  F  I  T  A  F  L  G  T  Y  T  W
         R  I  *  K  R  M  F  C  Y  L  L  Q  P  F  *  V  L  I  H  G

11641  GACCACTATTTTGTCATTAGCTATAGCAAAAATTGTTGCTAATTGGTTGTCTGTTAATAT  11700
       D  H  Y  F  V  I  S  Y  S  K  N  C  C  *  L  V  V  C  *  Y
        T  T  I  L  S  L  A  I  A  K  I  V  A  N  W  L  S  V  N  I
         P  L  F  C  H  *  L  *  Q  K  L  L  L  I  G  C  L  L  I  Y

11701  ATTTTATTTTACAGATGTACCTTATATTAAATTGATTCTCTTGAGTTACTTATTTATAGG  11760
       I  L  F  Y  R  C  T  L  Y  *  I  D  S  L  E  L  L  I  Y  R
        F  Y  F  T  D  V  P  Y  I  K  L  I  L  L  S  Y  L  F  I  G
         F  I  L  Q  M  Y  L  I  L  N  *  F  S  *  V  T  Y  L  *  G

11761  GTATATTTTATCTTGTTATTGGGGATTTTTCTCTCTTTTAAACAGTGTTTTTAGAATGCC  11820
       V  Y  F  I  L  L  L  G  I  F  L  S  F  K  Q  C  F  *  N  A
        Y  I  L  S  C  Y  W  G  F  F  S  L  L  N  S  V  F  R  M  P
         I  F  Y  L  V  I  G  D  F  S  L  F  *  T  V  F  L  E  C  L

11821  TATGGGTGTTTATAATTATAAAATTTCTGTTCAAGAATTGCGTTATATGAATGCTAATGG  11880
       Y  G  C  L  *  L  *  N  F  C  S  R  I  A  L  Y  E  C  *  W
        M  G  V  Y  N  Y  K  I  S  V  Q  E  L  R  Y  M  N  A  N  G
         W  V  F  I  I  I  K  F  L  F  K  N  C  V  I  *  M  L  M  A
```

FIG. 2 CONT.

```
11881   CTTACGTCCACCTCGTAATAGTTTTGAGGCTATTTTGTTAAATTTAAAACTGCTTGGAAT   11940
        L  T  S  T  S  *  *  F  *  G  Y  F  V  K  F  K  T  A  W  N
         L  R  P  P  R  N  S  F  E  A  I  L  L  N  L  K  L  L  G  I
          Y  V  H  L  V  I  V  L  R  L  F  C  *  I  *  N  C  L  E  *

11941   AGGTGGCGTGCCAGTTATTGAAGTCTCCCAAATTCAATCAAAATTGACTGATGTGAAATG   12000
        R  W  R  A  S  Y  *  S  L  P  N  S  I  K  I  D  *  C  E  M
         G  G  V  P  V  I  E  V  S  Q  I  Q  S  K  L  T  D  V  K  C
          V  A  C  Q  L  L  K  S  P  K  F  N  Q  N  *  L  M  *  N  V

12001   TGCTAATGTTGTTTTGTTAAATTGTTTACAGCATTTGCATGTTGCTTCTAATTCTAAGTT   12060
        C  *  C  C  F  V  K  L  F  T  A  F  A  C  C  F  *  F  *  V
         A  N  V  V  L  L  N  C  L  Q  H  L  H  V  A  S  N  S  K  L
          L  M  L  F  C  *  I  V  Y  S  I  C  M  L  L  L  I  L  S  C

12061   GTGGCAGTATTGTAGTGTTTTACATAATGAAATACTATCTACTTCAGATTTGAGTGTAGC   12120
        V  A  V  L  *  C  F  T  *  *  N  T  I  Y  F  R  F  E  C  S
         W  Q  Y  C  S  V  L  H  N  E  I  L  S  T  S  D  L  S  V  A
          G  S  I  V  V  F  Y  I  M  K  Y  Y  L  L  Q  I  *  V  *  L

12121   TTTTGATAAGCTTGCTCAATTATTGATTGTTTTATTCGCCAATCCTGCTGCAGTTGATAC   12180
        F  *  *  A  C  S  I  I  D  C  F  I  R  Q  S  C  C  S  *  Y
         F  D  K  L  A  Q  L  L  I  V  L  F  A  N  P  A  A  V  D  T
          L  I  S  L  L  N  Y  *  L  F  Y  S  P  I  L  L  Q  L  I  L

12181   TAAGTGTCTTGCAAGTATAGATGAAGTTAGCGATGATTATGTTCAAGATAGTACCGTTTT   12240
        *  V  S  C  K  Y  R  *  S  *  R  *  L  C  S  R  *  Y  R  F
         K  C  L  A  S  I  D  E  V  S  D  D  Y  V  Q  D  S  T  V  L
          S  V  L  Q  V  *  M  K  L  A  M  I  M  F  K  I  V  P  F  C

12241   GCAGGCTTTGCAAAGTGAGTTTGTAAATATGGCTAGTTTTGTTGAATATGAAGTCGCAAA   12300
        A  G  F  A  K  *  V  C  K  Y  G  *  F  C  *  I  *  S  R  K
         Q  A  L  Q  S  E  F  V  N  M  A  S  F  V  E  Y  E  V  A  K
          R  L  C  K  V  S  L  *  I  W  L  V  L  L  N  M  K  S  Q  R

12301   GAAAAATTTGGCTGATGCTAAAAATAGTGGTTCTGTTAATCAACAACAGATAAAACAGTT   12360
        E  K  F  G  *  C  *  K  *  W  F  C  *  S  T  T  D  K  T  V
         K  N  L  A  D  A  K  N  S  G  S  V  N  Q  Q  Q  I  K  Q  L
          K  I  W  L  M  L  K  I  V  V  L  L  I  N  N  R  *  N  S  *

12361   AGAAAAAGCATGTAATATAGCTAAGTCTGTGTATGAACGTGATAAAGCTGTAGCTCGCAA   12420
        R  K  S  M  *  Y  S  *  V  C  V  *  T  *  *  S  C  S  S  Q
         E  K  A  C  N  I  A  K  S  V  Y  E  R  D  K  A  V  A  R  K
          K  K  H  V  I  *  L  S  L  C  M  N  V  I  K  L  *  L  A  N
```

FIG. 2 CONT.

12421 ACTTGAACGTATGGCAGACCTAGCACTTACTAACATGTATAAAGAGGCTCGGATTAATGA 12480
T * T Y G R P S T Y * H V * R G S D * *
L E R M A D L A L T N M Y K E A R I N D
L N V W Q T * H L L T C I K R L G L M I

12481 TAAGAAGAGTAAAGTTGTTTCCGCTTTGCAGACAATGCTTTTTAGCATGGTTCGTAAATT 12540
* E E * S C F R F A D N A F * H G S * I
K K S K V V S A L Q T M L F S M V R K L
R R V K L F P L C R Q C F L A W F V N W

12541 GGATAATCAGGCTTTAAATTCTATTCTGGATAATGCTGTTAAAGGTTGTGTACCTTTGAG 12600
G * S G F K F Y S G * C C * R L C T F E
D N Q A L N S I L D N A V K G C V P L S
I I R L * I L F W I M L L K V V Y L * V

12601 TGCTATTCCAGCATTGGCTGCTAATACTTTAACTATAGTAATACCAGATAAACAAGTTTT 12660
C Y S S I G C * Y F N Y S N T R * T S F
A I P A L A A N T L T I V I P D K Q V F
L F Q H W L L I L * L * * Y Q I N K F L

12661 TGATAAAGTTGTTGATAATGTTTATGTTACATATGCTGGTAGTGTATGGCATATACAGAC 12720
* * S C * * C L C Y I C W * C M A Y T D
D K V V D N V Y V T Y A G S V W H I Q T
I K L L I M F M L H M L V V Y G I Y R L

12721 TGTTCAAGATGCTGATGGTATTAATAAACAGTTAACTGATATTAGTGTTGATTCTAATTG 12780
C S R C * W Y * * T V N * Y * C * F * L
V Q D A D G I N K Q L T D I S V D S N W
F K M L M V L I N S * L I L V L I L I G

12781 GCCTCTTGTTATCATTGCGAACAGGTATAATGAAGTTGCTAATGCTGTTATGCAGAATAA 12840
A S C Y H C E Q V * * S C * C C Y A E *
P L V I I A N R Y N E V A N A V M Q N N
L L L S L R T G I M K L L M L L C R I M

12841 TGAGTTGATGCCTCATAAATTAAAAATACAAGTTGTTAATAGTGGTTCTGATATGAATTG 12900
* V D A S * I K N T S C * * W F * Y E L
E L M P H K L K I Q V V N S G S D M N C
S * C L I N * K Y K L L I V V L I * I V

12901 TAATATTCCTACTCAATGTTATTATAATAATGGTAGTAGTGGTAGAATAGTTTATGCTGT 12960
* Y S Y S M L L * * W * * W * N S L C C
N I P T Q C Y Y N N G S S G R I V Y A V
I F L L N V I I I M V V V V E * F M L F

FIG. 2 CONT.

```
12961  TCTTAGTGATGTTGATGGTCTTAAGTATACTAAGATAATGAAAGATGATGGAAATTGTGT  13020
        S  *  *  C  *  W  S  *  V  Y  *  D  N  E  R  *  W  K  L  C
         L  S  D  V  D  G  L  K  Y  T  K  I  M  K  D  D  G  N  C  V
          L  V  M  L  M  V  L  S  I  L  R  *  *  K  M  M  E  I  V  L

13021  TGTTTTAGAGCTTGATCCTCCTTGTAAATTTTCTATACAAGATGTTAAGGGACTTAAAAT  13080
        C  F  R  A  *  S  S  L  *  I  F  Y  T  R  C  *  G  T  *  N
         V  L  E  L  D  P  P  C  K  F  S  I  Q  D  V  K  G  L  K  I
          F  *  S  L  I  L  L  V  N  F  L  Y  K  M  L  R  D  L  K  L

13081  TAAGTATCTTTATTTTATTAAAGGATGTAACACTTTAGCTAGAGGGTGGGTTGTTGGTAC  13140
        *  V  S  L  F  Y  *  R  M  *  H  F  S  *  R  V  G  C  W  Y
         K  Y  L  Y  F  I  K  G  C  N  T  L  A  R  G  W  V  V  G  T
          S  I  F  I  L  L  K  D  V  T  L  *  L  E  G  G  L  L  V  L

13141  TTTATCTTCAACAATTAGATTGCAGGCTGGTGTTGCTACTGAGTATGCAGCTAATTCTTC  13200
        F  I  F  N  N  *  I  A  G  W  C  C  Y  *  V  C  S  *  F  F
         L  S  S  T  I  R  L  Q  A  G  V  A  T  E  Y  A  A  N  S  S
          Y  L  Q  Q  L  D  C  R  L  V  L  L  L  S  M  Q  L  I  L  L

13201  TATACTTTCATTATGTGCATTTTCTGTAGATCCTAAGAAAACTTATTTAGATTATATACA  13260
        Y  T  F  I  M  C  I  F  C  R  S  *  E  N  L  F  R  L  Y  T
         I  L  S  L  C  A  F  S  V  D  P  K  K  T  Y  L  D  Y  I  Q
          Y  F  H  Y  V  H  F  L  *  I  L  R  K  L  I  *  I  I  Y  N

13261  ACAAGGTGGTGTACCTATAATTAATTGTGTTAAAATGCTCTGTGATCATGCTGGTACTGG  13320
        T  R  W  C  T  Y  N  *  L  C  *  N  A  L  *  S  C  W  Y  W
         Q  G  G  V  P  I  I  N  C  V  K  M  L  C  D  H  A  G  T  G
          K  V  V  Y  L  *  L  I  V  L  K  C  S  V  I  M  L  V  L  V

13321  TATGGCCATTACTATTAAACCTGAGGCTACTATTAACCAAGATTCTTATGGTGGTGCCTC  13380
        Y  G  H  Y  Y  *  T  *  G  Y  Y  *  P  R  F  L  W  W  C  L
         M  A  I  T  I  K  P  E  A  T  I  N  Q  D  S  Y  G  G  A  S
          W  P  L  L  L  N  L  R  L  L  L  T  K  I  L  M  V  V  P  Q

13381  AGTTTGTATTTATTGCCGTGCACGTGTAGAGCATCCAGATGTAGATGGTATATGTAAATT  13440
        S  L  Y  L  L  P  C  T  C  R  A  S  R  C  R  W  Y  M  *  I
         V  C  I  Y  C  R  A  R  V  E  H  P  D  V  D  G  I  C  K  L
          F  V  F  I  A  V  H  V  *  S  I  Q  M  *  M  V  Y  V  N  Y

13441  ACGTGGTAAATTTGTACAAGTCCCTTTGGGTATAAAAGATCCTATTCTTTATGTGTTAAC  13500
        T  W  *  I  C  T  S  P  F  G  Y  K  R  S  Y  S  L  C  V  N
         R  G  K  F  V  Q  V  P  L  G  I  K  D  P  I  L  Y  V  L  T
          V  V  N  L  Y  K  S  L  W  V  *  K  I  L  F  F  M  C  *  H
```

FIG. 2 CONT.

```
13501   ACATGATGTTTGTCAAGTCTGTGGTTTTTGGAGAGATGGCAGTTGTTCCTGTGTAGGTTC   13560
        T  *  C  L  S  S  L  W  F  L  E  R  W  Q  L  F  L  C  R  F
         H  D  V  C  Q  V  C  G  F  W  R  D  G  S  C  S  C  V  G  S
          M  M  F  V  K  S  V  V  F  G  E  M  A  V  V  P  V  *  V  Q

13561   AAGTGTCGCTGTTCAATCTAAAGATTTAAATTTTTTAAACGGGTTCGGGGTACTAGTGTG   13620
        K  C  R  C  S  I  *  R  F  K  F  F  K  R  V  R  G  T  S  V
         S  V  A  V  Q  S  K  D  L  N  F  L  N  G  F  G  V  L  V  *
          V  S  L  F  N  L  K  I  *  I  F  *  T  G  S  G  Y  *  C  E

13621   AATGCCCGGCTAGTACCCTGTGCTAGTGGTTTATCTACTGATGTTCAATTAAGGGCATTT   13680
        N  A  R  L  V  P  C  A  S  G  L  S  T  D  V  Q  L  R  A  F
         M  P  G  *  Y  P  V  L  V  V  Y  L  L  M  F  N  *  G  H  L
          C  P  A  S  T  L  C  *  W  F  I  Y  *  C  S  I  K  G  I  *

13681   GACATTTGTAATACCAATAGAGCTGGTATAGGTTTATATTATAAAGTGAATTGTTGCCGT   13740
        D  I  C  N  T  N  R  A  G  I  G  L  Y  Y  K  V  N  C  C  R
         T  F  V  I  P  I  E  L  V  *  V  Y  I  I  K  *  I  V  A  V
          H  L  *  Y  Q  *  S  W  Y  R  F  I  L  *  S  E  L  L  P  F

13741   TTTCAGCGTATAGATGACGACGGTAATAAATTGGATAAGTTCTTTGTTGTCAAAAGAACT   13800
        F  Q  R  I  D  D  D  G  N  K  L  D  K  F  F  V  V  K  R  T
         F  S  V  *  M  T  T  V  I  N  W  I  S  S  L  L  S  K  E  L
          S  A  Y  R  *  R  R  *  *  I  G  *  V  L  C  C  Q  K  N  *

13801   AATTTAGAAGTTTATAATAAAGAGAAAACTTATTATGAGTTGACTAAAAGTTGTGGTGTT   13860
        N  L  E  V  Y  N  K  E  K  T  Y  Y  E  L  T  K  S  C  G  V
         I  *  K  F  I  I  K  R  K  L  I  M  S  *  L  K  V  V  V  L
          F  R  S  L  *  *  R  E  N  L  L  *  V  D  *  K  L  W  C  C

13861   GTGGCTGAACATGATTTCTTTACATTTGATATTGATGGTAGTCGCGTGCCACATATAGTT   13920
        V  A  E  H  D  F  F  T  F  D  I  D  G  S  R  V  P  H  I  V
         W  L  N  M  I  S  L  H  L  I  L  M  V  V  A  C  H  I  *  F
          G  *  T  *  F  L  Y  I  *  Y  *  W  *  S  R  A  T  Y  S  S

13921   CGTAGGAATCTTTCAAAGTATACTATGTTAGATCTTTGCTATGCATTGCGTCATTTTGAT   13980
        R  R  N  L  S  K  Y  T  M  L  D  L  C  Y  A  L  R  H  F  D
         V  G  I  F  Q  S  I  L  C  *  I  F  A  M  H  C  V  I  L  I
          *  E  S  F  K  V  Y  Y  V  R  S  L  L  C  I  A  S  F  *  S

13981   CGTAATGATTGTTCAATATTGTGTGAAATTCTTTGTGAGTATGCTGATTGTAAAGAATCC   14040
        R  N  D  C  S  I  L  C  E  I  L  C  E  Y  A  D  C  K  E  S
         V  M  I  V  Q  Y  C  V  K  F  F  V  S  M  L  I  V  K  N  P
          *  *  L  F  N  I  V  *  N  S  L  *  V  C  *  L  *  R  I  L
```

FIG. 2 CONT.

```
14041  TACTTTTCTAAGAAAGATTGGTATGATTTTGTTGAAAATCCTGATATTATTAATATATAT  14100
       Y  F  S  K  K  D  W  Y  D  F  V  E  N  P  D  I  I  N  I  Y
        T  F  L  R  K  I  G  M  I  L  L  K  I  L  I  L  L  I  Y  I
         L  F  *  E  R  L  V  *  F  C  *  K  S  *  Y  Y  *  Y  I  *

14101  AAAAAATTAGGCCCTATTTTTAATAGAGCTTTACTTAATACTGTCATTTTTGCAGACACC  14160
       K  K  L  G  P  I  F  N  R  A  L  L  N  T  V  I  F  A  D  T
        K  N  *  A  L  F  L  I  E  L  Y  L  I  L  S  F  L  Q  T  P
         K  I  R  P  Y  F  *  *  S  F  T  *  Y  C  H  F  C  R  H  L

14161  TTAGTTGAAGTAGGTTTAGTTGGTGTTTTAACTTTAGATAACCAAGATTTGTATGGTCAA  14220
       L  V  E  V  G  L  V  G  V  L  T  L  D  N  Q  D  L  Y  G  Q
        *  L  K  *  V  *  L  V  F  *  L  *  I  T  K  I  C  M  V  N
         S  *  S  R  F  S  W  C  F  N  F  R  *  P  R  F  V  W  S  M

14221  TGGTATGATTTTGGTGATTTTATACAAACAGCCCCAGGGTTTGGTGTGGCAGTTGCAGAT  14280
       W  Y  D  F  G  D  F  I  Q  T  A  P  G  F  G  V  A  V  A  D
        G  M  I  L  V  I  L  Y  K  Q  P  Q  G  L  V  W  Q  L  Q  I
         V  *  F  W  *  F  Y  T  N  S  P  R  V  W  C  G  S  C  R  F

14281  TCTTACTATTCTTATATGATGCCTATGTTGACTATGTGTCATGTATTAGATTGTGAATTA  14340
       S  Y  Y  S  Y  M  M  P  M  L  T  M  C  H  V  L  D  C  E  L
        L  T  I  L  I  *  C  L  C  *  L  C  V  M  Y  *  I  V  N  Y
         L  L  F  L  Y  D  A  Y  V  D  Y  V  S  C  I  R  L  *  I  I

14341  TTTGTTAATGATAGTTATAGACAATTCGATCTTGTACAGTATGATTTTACTGATTACAAG  14400
       F  V  N  D  S  Y  R  Q  F  D  L  V  Q  Y  D  F  T  D  Y  K
        L  L  M  I  V  I  D  N  S  I  L  Y  S  M  I  L  L  I  T  S
         C  *  *  *  L  *  T  I  R  S  C  T  V  *  F  Y  *  L  Q  V

14401  TTAGAGTTGTTTAATAAGTATTTTAAGTATTGGGGTATGAAGTATCATCCTAATACTGTG  14460
       L  E  L  F  N  K  Y  F  K  Y  W  G  M  K  Y  H  P  N  T  V
        *  S  C  L  I  S  I  L  S  I  G  V  *  S  I  I  L  I  L  W
         R  V  V  *  *  V  F  *  V  L  G  Y  E  V  S  S  *  Y  C  G

14461  GATTGTGATAATGATAGGTGTATTATTCATTGTGCTAATTTTAATATACTATTTAGTATG  14520
       D  C  D  N  D  R  C  I  I  H  C  A  N  F  N  I  L  F  S  M
        I  V  I  M  I  G  V  L  F  I  V  L  I  L  I  Y  Y  L  V  W
         L  *  *  *  *  V  Y  Y  S  L  C  *  F  *  Y  T  I  *  Y  G

14521  GTTTTACCTAATACTTGTTTTGGTCCCCTTGTTAGACAAATTTTTGTAGATGGTGTACCG  14580
       V  L  P  N  T  C  F  G  P  L  V  R  Q  I  F  V  D  G  V  P
        F  Y  L  I  L  V  L  V  P  L  L  D  K  F  L  *  M  V  Y  R
         F  T  *  Y  L  F  W  S  P  C  *  T  N  F  C  R  W  C  T  V
```

FIG. 2 CONT.

```
14581  TTTGTTGTTTCTATTGGTTACCATTACAAAGAGTTAGGTGTAGTTATGAACTTAGATGTT  14640
       F  V  V  S  I  G  Y  H  Y  K  E  L  G  V  V  M  N  L  D  V
        L  L  F  L  L  V  T  I  T  K  S  *  V  *  L  *  T  *  M  L
         C  C  F  Y  W  L  P  L  Q  R  V  R  C  S  Y  E  L  R  C  *

14641  GACACACACCGTTATCGTTTGTCTCTTAAAGATTTACTTCTTTATGCAGCAGATCCTGCT  14700
       D  T  H  R  Y  R  L  S  L  K  D  L  L  L  Y  A  A  D  P  A
        T  H  T  V  I  V  C  L  L  K  I  Y  F  F  M  Q  Q  I  L  L
         H  T  P  L  S  F  V  S  *  R  F  T  S  L  C  S  R  S  C  Y

14701  ATGCACGTTGCATCTGCTAGTGCTCTGCTTGATTTACGAACTTGTTGTTTTAGTGTAGCT  14760
       M  H  V  A  S  A  S  A  L  L  D  L  R  T  C  C  F  S  V  A
        C  T  L  H  L  L  V  L  C  L  I  Y  E  L  V  V  L  V  *  L
         A  R  C  I  C  *  C  S  A  *  F  T  N  L  L  F  *  C  S  C

14761  GCCATTACAAGTGGTATAAAATTTCAAACTGTAAAACCAGGTAACTTTAACCAAGACTTT  14820
       A  I  T  S  G  I  K  F  Q  T  V  K  P  G  N  F  N  Q  D  F
        P  L  Q  V  V  *  N  F  K  L  *  N  Q  V  T  L  T  K  T  F
         H  Y  K  W  Y  K  I  S  N  C  K  T  R  *  L  *  P  R  L  L

14821  TACGAGTTTGTTAAAAGTAAAGGCTTGTTTAAAGAGGGTAGTACAGTTGATTTGAAACAT  14880
       Y  E  F  V  K  S  K  G  L  F  K  E  G  S  T  V  D  L  K  H
        T  S  L  L  K  V  K  A  C  L  K  R  V  V  Q  L  I  *  N  I
         R  V  C  *  K  *  R  L  V  *  R  G  *  Y  S  *  F  E  T  F

14881  TTTTTCTTTACTCAAGATGGTAATGCTGCAATTACTGATTATAATTATTATAAGTATAAT  14940
       F  F  F  T  Q  D  G  N  A  A  I  T  D  Y  N  Y  Y  K  Y  N
        F  S  L  L  K  M  V  M  L  Q  L  L  I  I  I  I  I  S  I  I
         F  L  Y  S  R  W  *  C  C  N  Y  *  L  *  L  L  *  V  *  F

14941  TTACCTACTATGGTTGATATTAAGCAGTTATTGTTTGTATTAGAAGTTGTTTATAAATAT  15000
       L  P  T  M  V  D  I  K  Q  L  L  F  V  L  E  V  V  Y  K  Y
        Y  L  L  W  L  I  L  S  S  Y  C  L  Y  *  K  L  F  I  N  I
         T  Y  Y  G  *  Y  *  A  V  I  V  C  I  R  S  C  L  *  I  F

15001  TTTGAAATTTATGATGGTGGTTGTATACCAGCATCACAAGTTATTGTTAATAATTATGAT  15060
       F  E  I  Y  D  G  G  C  I  P  A  S  Q  V  I  V  N  N  Y  D
        L  K  F  M  M  V  V  V  Y  Q  H  H  K  L  L  L  I  I  M  I
         *  N  L  *  W  W  L  Y  T  S  I  T  S  Y  C  *  *  L  *  *

15061  AAAAGTGCTGGTTATCCATTTAATAAATTTGGTAAAGCCAGACTTTATTATGAGGCATTA  15120
       K  S  A  G  Y  P  F  N  K  F  G  K  A  R  L  Y  Y  E  A  L
        K  V  L  V  I  H  L  I  N  L  V  K  P  D  F  I  M  R  H  Y
         K  C  W  L  S  I  *  *  I  W  *  S  Q  T  L  L  *  G  I  I
```

FIG. 2 CONT.

```
15121  TCATTTGAGGAACAGAATGAAATTTATGCATATACTAAACGTAATGTTCTGCCCACCTTA  15180
       S  F  E  E  Q  N  E  I  Y  A  Y  T  K  R  N  V  L  P  T  L
        H  L  R  N  R  M  K  F  M  H  I  L  N  V  M  F  C  P  P  *
         I  *  G  T  E  *  N  L  C  I  Y  *  T  *  C  S  A  H  L  N

15181  ACTCAAATGAATTTAAAATATGCTATCAGTGCTAAGAATAGAGCTCGCACTGTAGCAGGT  15240
       T  Q  M  N  L  K  Y  A  I  S  A  K  N  R  A  R  T  V  A  G
        L  K  *  I  *  N  M  L  S  V  L  R  I  E  L  A  L  *  Q  V
         S  N  E  F  K  I  C  Y  Q  C  *  E  *  S  S  H  C  S  R  C

15241  GTTTCTATTCTTAGTACTATGACAGGCCGAATGTTCCATCAAAAATGTTTGAAGAGTATA  15300
       V  S  I  L  S  T  M  T  G  R  M  F  H  Q  K  C  L  K  S  I
        F  L  F  L  V  L  *  Q  A  E  C  S  I  K  N  V  *  R  V  *
         F  Y  S  *  Y  Y  D  R  P  N  V  P  S  K  M  F  E  E  Y  S

15301  GCAGCTACCCGAGGTGTTCCTGTTGTTATAGGAACCACTAAATTTTATGGTGGTTGGGAC  15360
       A  A  T  R  G  V  P  V  V  I  G  T  T  K  F  Y  G  G  W  D
        Q  L  P  E  V  F  L  L  L  *  E  P  L  N  F  M  V  V  G  T
         S  Y  P  R  C  S  C  C  Y  R  N  H  *  I  L  W  W  L  G  R

15361  GATATGTTACGTCATCTTATAAAGGATGTTGACAACCCTGTTCTTATGGGTTGGGATTAT  15420
       D  M  L  R  H  L  I  K  D  V  D  N  P  V  L  M  G  W  D  Y
        I  C  Y  V  I  L  *  R  M  L  T  T  L  F  L  W  V  G  I  I
         Y  V  T  S  S  Y  K  G  C  *  Q  P  C  S  Y  G  L  G  L  S

15421  CCTAAATGTGATCGTGCTATGCCAAATATTTTGCGTATTGTTAGTAGTTTAGTTTTGGCC  15480
       P  K  C  D  R  A  M  P  N  I  L  R  I  V  S  S  L  V  L  A
        L  N  V  I  V  L  C  Q  I  F  C  V  L  L  V  V  *  F  W  P
         *  M  *  S  C  Y  A  K  Y  F  A  Y  C  *  *  F  S  F  G  P

15481  CGCAAACATGAATTTTGTTGTTCACATGGTGATAGATTTTATCGCCTTGCGAATGAATGT  15540
       R  K  H  E  F  C  C  S  H  G  D  R  F  Y  R  L  A  N  E  C
        A  N  M  N  F  V  V  H  M  V  I  D  F  I  A  L  R  M  N  V
         Q  T  *  I  L  L  F  T  W  *  *  I  L  S  P  C  E  *  M  C

15541  GCTCAAGTTTTGAGTGAAATAGTTATGTGTGGCGGTTGCTATTATGTTAAGCCTGGTGGT  15600
       A  Q  V  L  S  E  I  V  M  C  G  G  C  Y  Y  V  K  P  G  G
        L  K  F  *  V  K  *  L  C  V  A  V  A  I  M  L  S  L  V  V
         S  S  F  E  *  N  S  Y  V  W  R  L  L  L  C  *  A  W  W  Y

15601  ACTAGCAGTGGTGATGCAACTACTGCTTTTGCTAATTCTGTTTTTAATATATGTCAGGCT  15660
       T  S  S  G  D  A  T  T  A  F  A  N  S  V  F  N  I  C  Q  A
        L  A  V  V  M  Q  L  L  L  L  L  I  L  F  L  I  Y  V  R  L
         *  Q  W  *  C  N  Y  C  F  C  *  F  C  F  *  Y  M  S  G  C
```

FIG. 2 CONT.

15661 GTTACTGCTAATGTTTGTTCTCTTATGGCCTGTAATGGCCATAAGATTGAAGATTTAAGT 15720
V T A N V C S L M A C N G H K I E D L S
L L L M F V L L W P V M A I R L K I * V
Y C * C L F S Y G L * W P * D * R F K Y

15721 ATACGCAATTTACAAAAACGCTTATACTCTAATGTTTATCGTACAGATTATGTTGATTAT 15780
I R N L Q K R L Y S N V Y R T D Y V D Y
Y A I Y K N A Y T L M F I V Q I M L I I
T Q F T K T L I L * C L S Y R L C * L Y

15781 ACATTTGTTAATGAGTATTATGAATTTTTATGTAAGCATTTTAGTATGATGATTTTGAGT 15840
T F V N E Y Y E F L C K H F S M M I L S
H L L M S I M N F Y V S I L V * * F * V
I C * * V L * I F M * A F * Y D D F E *

15841 GATGATGGTGTTGTCTGTTATAACTCTGATTATGCTAGTAAGGGTTATATAGCTAATATA 15900
D D G V V C Y N S D Y A S K G Y I A N I
M M V L S V I T L I M L V R V I * L I *
* W C C L L * L * L C * * G L Y S * Y K

15901 AGTGTTTTTCAACAAGTTTTGTACTATCAGAATAATGTCTTTATGTCTGAATCTAAATGT 15960
S V F Q Q V L Y Y Q N N V F M S E S K C
V F F N K F C T I R I M S L C L N L N V
C F S T S F V L S E * C L Y V * I * M L

15961 TGGGTTGAAAATGATATTACTAATGGTCCTCATGAATTTTGTTCCCAACATACTATGTTA 16020
W V E N D I T N G P H E F C S Q H T M L
G L K M I L L M V L M N F V P N I L C *
G * K * Y Y * W S S * I L F P T Y Y V S

16021 GTTAAGATAGATGGTGATTATGTTTATTTACCATATCCAGATCCTTCTAGAATTTTAGGA 16080
V K I D G D Y V Y L P Y P D P S R I L G
L R * M V I M F I Y H I Q I L L E F * E
* D R W * L C L F T I S R S F * N F R S

16081 GCTGGTTGTTTTGTTGATGATTTATTGAAGACTGACAGTGTTCTTTTGATAGAGCGCTTT 16140
A G C F V D D L L K T D S V L L I E R F
L V V L L M I Y * R L T V F F * * S A L
W L F C * * F I E D * Q C S F D R A L C

16141 GTAAGTCTAGCTATAGATGCTTACCCTTTAGTACATCATGAAAATGAAGAATACCAAAAA 16200
V S L A I D A Y P L V H H E N E E Y Q K
* V * L * M L T L * Y I M K M K N T K K
K S S Y R C L P F S T S * K * R I P K S

FIG. 2 CONT.

```
16201   GTCTTTCGTGTATATTTAGAATATATAAAAAAACTGTATAATGATCTTGGTACTCAGATC   16260
        V  F  R  V  Y  L  E  Y  I  K  K  L  Y  N  D  L  G  T  Q  I
         S  F  V  Y  I  *  N  I  *  K  N  C  I  M  I  L  V  L  R  S
          L  S  C  I  F  R  I  Y  K  K  T  V  *  *  S  W  Y  S  D  L

16261   TTAGATAGTTATAGTGTTATTTTAAGTACTTGTGATGGTTTAAAGTTTACTGAAGAATCA   16320
        L  D  S  Y  S  V  I  L  S  T  C  D  G  L  K  F  T  E  E  S
         *  I  V  I  V  L  F  *  V  L  V  M  V  *  S  L  L  K  N  H
          R  *  L  *  C  Y  F  K  Y  L  *  W  F  K  V  Y  *  R  I  I

16321   TTTTACAAGAATATGTATTTAAAAAGTGCCGTGATGCAGAGTGTAGGTGCATGCGTTGTT   16380
        F  Y  K  N  M  Y  L  K  S  A  V  M  Q  S  V  G  A  C  V  V
         F  T  R  I  C  I  *  K  V  P  *  C  R  V  *  V  H  A  L  F
          L  Q  E  Y  V  F  K  K  C  R  D  A  E  C  R  C  M  R  C  L

16381   TGTTCATCACAAACTTCTTTGCGTTGTGGCAGTTGTATACGTAAGCCTTTGTTATGTTGT   16440
        C  S  S  Q  T  S  L  R  C  G  S  C  I  R  K  P  L  L  C  C
         V  H  H  K  L  L  C  V  V  A  V  V  Y  V  S  L  C  Y  V  V
          F  I  T  N  F  F  A  L  W  Q  L  Y  T  *  A  F  V  M  L  *

16441   AAATGTTGTTATGACCATGTTATGGCAACTAATCATAAATATGTTTTGAGTGTCTCACCT   16500
        K  C  C  Y  D  H  V  M  A  T  N  H  K  Y  V  L  S  V  S  P
         N  V  V  M  T  M  L  W  Q  L  I  I  N  M  F  *  V  S  H  L
          M  L  L  *  P  C  Y  G  N  *  S  *  I  C  F  E  C  L  T  L

16501   TACGTTTGTAATGCACCTAACTGTGATGTGAGTGATGTCACCAAATTATATTTGGGCGGT   16560
        Y  V  C  N  A  P  N  C  D  V  S  D  V  T  K  L  Y  L  G  G
         T  F  V  M  H  L  T  V  M  *  V  M  S  P  N  Y  I  W  A  V
          R  L  *  C  T  *  L  *  C  E  *  C  H  Q  I  I  F  G  R  Y

16561   ATGTCTTACTATTGTGAAAACCATAAACCCCATTATTCATTTAAGTTAGTTATGAATGGT   16620
        M  S  Y  Y  C  E  N  H  K  P  H  Y  S  F  K  L  V  M  N  G
         C  L  T  I  V  K  T  I  N  P  I  I  H  L  S  *  L  *  M  V
          V  L  L  L  *  K  P  *  T  P  L  F  I  *  V  S  Y  E  W  Y

16621   ATGGTCTTTGGTTTGTATAAACAATCTTGCACGGGTTCACCTTATATAGATGATTTTAAT   16680
        M  V  F  G  L  Y  K  Q  S  C  T  G  S  P  Y  I  D  D  F  N
         W  S  L  V  C  I  N  N  L  A  R  V  H  L  I  *  M  I  L  I
          G  L  W  F  V  *  T  I  L  H  G  F  T  L  Y  R  *  F  *  *

16681   AAGATAGCTAGTTGTAAATGGACAGAAGTTGATGATTATGTTCTGGCAAATGAGTGTATT   16740
        K  I  A  S  C  K  W  T  E  V  D  D  Y  V  L  A  N  E  C  I
         R  *  L  V  V  N  G  Q  K  L  M  I  M  F  W  Q  M  S  V  L
          D  S  *  L  *  M  D  R  S  *  *  L  C  S  G  K  *  V  Y  *
```

FIG. 2 CONT.

16741 GAACGTTTAAAGTTATTTGCTGCAGAAACTCAAAAGGCAACTGAAGAGGCTTTTAAACAA 16800
E R L K L F A A E T Q K A T E E A F K Q
N V * S Y L L Q K L K R Q L K R L L N K
T F K V I C C R N S K G N * R G F * T K

16801 AGCTATGCTTCTGCTACCATTCAAGAGATTGTTAGTGATAGAGAAGTTATTTTGTGTTGG 16860
S Y A S A T I Q E I V S D R E V I L C W
A M L L L P F K R L L V I E K L F C V G
L C F C Y H S R D C * * * R S Y F V L G

16861 GAGACAGGTAAAGTTAAACCACCACTTAATAAAAATTATGTTTTCACAGGCTACCATTTT 16920
E T G K V K P P L N K N Y V F T G Y H F
R Q V K L N H H L I K I M F S Q A T I L
D R * S * T T T * * K L C F H R L P F Y

16921 ACTAGTACTGGTAAGACAGTTTTAGGTGAGTATGTTTTTGATAAAAGTGAATTAACTAAC 16980
T S T G K T V L G E Y V F D K S E L T N
L V L V R Q F * V S M F L I K V N * L T
* Y W * D S F R * V C F * * K * I N * R

16981 GGTGTGTATTACCGCGCTACAACTACTTATAAACTTTCTATAGGTGATGTTTTTGTTTTA 17040
G V Y Y R A T T T Y K L S I G D V F V L
V C I T A L Q L L I N F L * V M F L F *
C V L P R Y N Y L * T F Y R * C F C F N

17041 ACATCACATTCTGTAGCTAGTTTAAGTGCACCTACACTTGTCCCACAAGAGAACTATGCT 17100
T S H S V A S L S A P T L V P Q E N Y A
H H I L * L V * V H L H L S H K R T M L
I T F C S * F K C T Y T C P T R E L C *

17101 AGTATAAGATTTTCTAGTGTTTATAGTGTTCCATTGGTGTTTCAAAATAATGTTGCTAAT 17160
S I R F S S V Y S V P L V F Q N N V A N
V * D F L V F I V F H W C F K I M L L I
Y K I F * C L * C S I G V S K * C C * L

17161 TATCAGCACATTGGAATGAAACGTTATTGCACTGTTCAAGGTCCCCCTGGTACGGGAAAG 17220
Y Q H I G M K R Y C T V Q G P P G T G K
I S T L E * N V I A L F K V P L V R E S
S A H W N E T L L H C S R S P W Y G K V

17221 TCTCATCTTGCTATAGGTCTAGCTGTTTATTACTACACAGCACGTGTAGTTTATACTGCT 17280
S H L A I G L A V Y Y Y T A R V V Y T A
L I L L * V * L F I T T Q H V * F I L L
S S C Y R S S C L L L H S T C S L Y C C

FIG. 2 CONT.

```
17281    GCTAGTCATGCTGCTGTAGATGCATTGTGTGAAAAAGCTTATAAGTTTTTAAATATTAAC    17340
         A  S  H  A  A  V  D  A  L  C  E  K  A  Y  K  F  L  N  I  N
          L  V  M  L  L  *  M  H  C  V  K  K  L  I  S  F  *  I  L  T
           *  S  C  C  C  R  C  I  V  *  K  S  L  *  V  F  K  Y  *  R

17341    GATTGTACACGTATTATTCCTGCTAAAGTTCGTGTAGATTGTTATGATAAGTTTAAAATT    17400
         D  C  T  R  I  I  P  A  K  V  R  V  D  C  Y  D  K  F  K  I
          I  V  H  V  L  F  L  L  K  F  V  *  I  V  M  I  S  L  K  L
           L  Y  T  Y  Y  S  C  *  S  S  C  R  L  L  *  *  V  *  N  *

17401    AATGATACCACTTGTAAGTATGTTTTTACCACAATAAATGCATTACCAGAGTTGGTTACA    17460
         N  D  T  T  C  K  Y  V  F  T  T  I  N  A  L  P  E  L  V  T
          M  I  P  L  V  S  M  F  L  P  Q  *  M  H  Y  Q  S  W  L  Q
           *  Y  H  L  *  V  C  F  Y  H  N  K  C  I  T  R  V  G  Y  R

17461    GATATTGTTGTTGTTGATGAAGTTAGTATGCTTACTAATTATGAATTGTCTGTTATAAAT    17520
         D  I  V  V  V  D  E  V  S  M  L  T  N  Y  E  L  S  V  I  N
          I  L  L  L  L  M  K  L  V  C  L  L  I  M  N  C  L  L  *  M
           Y  C  C  C  *  *  S  *  Y  A  Y  *  L  *  I  V  C  Y  K  C

17521    GCTCGTATTAAAGCTAAACATTATGTATATATTGGAGATCCTGCTCAATTACCTGCACCA    17580
         A  R  I  K  A  K  H  Y  V  Y  I  G  D  P  A  Q  L  P  A  P
          L  V  L  K  L  N  I  M  Y  I  L  E  I  L  L  N  Y  L  H  H
           S  Y  *  S  *  T  L  C  I  Y  W  R  S  C  S  I  T  C  T  T

17581    CGTGTGCTGTTGAGCAAGGGTTCTTTAGAACCTAGGCACTTCAATTCTATTACTAAAATA    17640
         R  V  L  L  S  K  G  S  L  E  P  R  H  F  N  S  I  T  K  I
          V  C  C  *  A  R  V  L  *  N  L  G  T  S  I  L  L  L  K  *
           C  A  V  E  Q  G  F  F  R  T  *  A  L  Q  F  Y  Y  *  N  N

17641    ATGTGTTGTTTAGGTCCTGATATCTTTTTGGGAAATTGTTATAGGTGTCCTAAAGAAATT    17700
         M  C  C  L  G  P  D  I  F  L  G  N  C  Y  R  C  P  K  E  I
          C  V  V  *  V  L  I  S  F  W  E  I  V  I  G  V  L  K  K  L
           V  L  F  R  S  *  Y  L  F  G  K  L  L  *  V  S  *  R  N  C

17701    GTAGAAACTGTTTCAGCATTGGTTTATGATAATAAACTCAAGGCTAAAAATGATAATAGT    17760
         V  E  T  V  S  A  L  V  Y  D  N  K  L  K  A  K  N  D  N  S
          *  K  L  F  Q  H  W  F  M  I  I  N  S  R  L  K  M  I  I  V
           R  N  C  F  S  I  G  L  *  *  *  T  Q  G  *  K  *  *  *  F

17761    TCATTATGTTTTAAAGTATATTTTAAGGGACAGACAACACATGAGAGTTCAAGTGCTGTA    17820
         S  L  C  F  K  V  Y  F  K  G  Q  T  T  H  E  S  S  S  A  V
          H  Y  V  L  K  Y  I  L  R  D  R  Q  H  M  R  V  Q  V  L  *
           I  M  F  *  S  I  F  *  G  T  D  N  T  *  E  F  K  C  C  K
```

FIG. 2 CONT.

```
17821   AATATTCAACAGATATATCTAATTAGTAAATTTTTAAAAGCTAATCCAGTTTGGAATAGT   17880
        N  I  Q  Q  I  Y  L  I  S  K  F  L  K  A  N  P  V  W  N  S
         I  F  N  R  Y  I  *  L  V  N  F  *  K  L  I  Q  F  G  I  V
          Y  S  T  D  I  S  N  *  *  I  F  K  S  *  S  S  L  E  *  C

17881   GCTGTTTTTATTAGTCCTTATAATAGTCAGAATTATGTTGCTAAGCGTGTTTTAGGTGTT   17940
        A  V  F  I  S  P  Y  N  S  Q  N  Y  V  A  K  R  V  L  G  V
         L  F  L  L  V  L  I  I  V  R  I  M  L  L  S  V  F  *  V  F
          C  F  Y  *  S  L  *  *  S  E  L  C  C  *  A  C  F  R  C  S

17941   CAAACACAAACTGTAGATTCTGCTCAAGGTTCGGAATATGATTATGTTATATATTCACAA   18000
        Q  T  Q  T  V  D  S  A  Q  G  S  E  Y  D  Y  V  I  Y  S  Q
         K  H  K  L  *  I  L  L  K  V  R  N  M  I  M  L  Y  I  H  K
          N  T  N  C  R  F  C  S  R  F  G  I  *  L  C  Y  I  F  T  N

18001   ACAGCAGAAACAGCCCATTCTGTTAATGTTAATCGATTTAATGTTGCCATAACTAGAGCC   18060
        T  A  E  T  A  H  S  V  N  V  N  R  F  N  V  A  I  T  R  A
         Q  Q  K  Q  P  I  L  L  M  L  I  D  L  M  L  P  *  L  E  P
          S  R  N  S  P  F  C  *  C  *  S  I  *  C  C  H  N  *  S  Q

18061   AAGAAGGGCATTTTTTGTGTTATGAGTAATATGCAATTATTTGAATCTCTTAATTTTATT   18120
        K  K  G  I  F  C  V  M  S  N  M  Q  L  F  E  S  L  N  F  I
         R  R  A  F  F  V  L  *  V  I  C  N  Y  L  N  L  L  I  L  L
          E  G  H  F  L  C  Y  E  *  Y  A  I  I  *  I  S  *  F  Y  Y

18121   ACTCTACCTTTAGATAAAATTCAAAATCAAACTTTACCTCGTTTGCATTGCACAACTAAT   18180
        T  L  P  L  D  K  I  Q  N  Q  T  L  P  R  L  H  C  T  T  N
         L  Y  L  *  I  K  F  K  I  K  L  Y  L  V  C  I  A  Q  L  I
          S  T  F  R  *  N  S  K  S  N  F  T  S  F  A  L  H  N  *  S

18181   CTTTTTAAAGATTGTAGTAAAAGTTGCTTAGGTTATCATCCAGCGCATGCCCCCTCATTT   18240
        L  F  K  D  C  S  K  S  C  L  G  Y  H  P  A  H  A  P  S  F
         F  L  K  I  V  V  K  V  A  *  V  I  I  Q  R  M  P  P  H  F
          F  *  R  L  *  *  K  L  L  R  L  S  S  S  A  C  P  L  I  F

18241   TTAGCAGTTGATGATAAATATAAGGTTAATGAAAATTTGGCTGTAAATTTAAATATTTGT   18300
        L  A  V  D  D  K  Y  K  V  N  E  N  L  A  V  N  L  N  I  C
         *  Q  L  M  I  N  I  R  L  M  K  I  W  L  *  I  *  I  F  V
          S  S  *  *  *  I  *  G  *  *  K  F  G  C  K  F  K  Y  L  *

18301   GAACCTGTTTTAACATATTCTCGTTTAATATCTCTTATGGGTTTTAAATTAGATTTGACT   18360
        E  P  V  L  T  Y  S  R  L  I  S  L  M  G  F  K  L  D  L  T
         N  L  F  *  H  I  L  V  *  Y  L  L  W  V  L  N  *  I  *  L
          T  C  F  N  I  F  S  F  N  I  S  Y  G  F  *  I  R  F  D  S
```

FIG. 2 CONT.

18361 CTTGATGGTTATTCTAAATTGTTTATTACTAAAGATGAAGCCATTAAACGTGTTAGAGGT 18420
L D G Y S K L F I T K D E A I K R V R G
L M V I L N C L L L K M K P L N V L E V
* W L F * I V Y Y * R * S H * T C * R L

18421 TGGGTTGGTTTTGATGTTGAGGGCGCTCATGCTACTCGCGAAAACATTGGAACAAACTTT 18480
W V G F D V E G A H A T R E N I G T N F
G L V L M L R A L M L L A K T L E Q T F
G W F * C * G R S C Y S R K H W N K L S

18481 CCACTGCAAATAGGTTTTTCAACTGGTGTGGATTTTGTAGTTGAAGCTACTGGCTTATTT 18540
P L Q I G F S T G V D F V V E A T G L F
H C K * V F Q L V W I L * L K L L A Y L
T A N R F F N W C G F C S * S Y W L I C

18541 GCTGAGAGAGATTGTTATACTTTTAAAAAAACTGTAGCTAAAGCTCCTCCTGGTGAAAAA 18600
A E R D C Y T F K K T V A K A P P G E K
L R E I V I L L K K L * L K L L L V K N
* E R L L Y F * K N C S * S S S W * K I

18601 TTTAAACATTTAATACCCCTTATGTCAAAAGGTCAAAAGTGGGATATTGTTAGAATTAGA 18660
F K H L I P L M S K G Q K W D I V R I R
L N I * Y P L C Q K V K S G I L L E L E
* T F N T P Y V K R S K V G Y C * N * N

18661 ATTGTTCAAATGTTATCTGATTATCTTTTAGACCTTTCTGATAGTGTAGTATTTATTACT 18720
I V Q M L S D Y L L D L S D S V V F I T
L F K C Y L I I F * T F L I V * Y L L L
C S N V I * L S F R P F * * C S I Y Y L

18721 TGGTCTGCCAGTTTTGAACTTACTTGTTTAAGGTATTTTGCTAAATTAGGCAGAGAGCTT 18780
W S A S F E L T C L R Y F A K L G R E L
G L P V L N L L V * G I L L N * A E S L
V C Q F * T Y L F K V F C * I R Q R A *

18781 AATTGTAATGTGTGTTCTAATCGTGCTACATGCTACAATTCTAGAACTGGTTATTATGGT 18840
N C N V C S N R A T C Y N S R T G Y Y G
I V M C V L I V L H A T I L E L V I M V
L * C V F * S C Y M L Q F * N W L L W L

18841 TGTTGGCGCCATAGTTATACTTGTGATTATGTGTATAATCCACTTATTGTAGATATACAA 18900
C W R H S Y T C D Y V Y N P L I V D I Q
V G A I V I L V I M C I I H L L * I Y N
L A P * L Y L * L C V * S T Y C R Y T T

FIG. 2 CONT.

```
18901   CAGTGGGGTTATACAGGTTCTTTAACTAGTAATCACGATATAATTTGTAATGTACATAAA   18960
        Q  W  G  Y  T  G  S  L  T  S  N  H  D  I  I  C  N  V  H  K
         S  G  V  I  Q  V  L  *  L  V  I  T  I  *  F  V  M  Y  I  K
          V  G  L  Y  R  F  F  N  *  *  S  R  Y  N  L  *  C  T  *  R

18961   GGTGCACATGTTGCGTCAGCTGATGCAATTATGACTCGTTGTTTAGCAATCTATGATTGT   19020
        G  A  H  V  A  S  A  D  A  I  M  T  R  C  L  A  I  Y  D  C
         V  H  M  L  R  Q  L  M  Q  L  *  L  V  V  *  Q  S  M  I  V
          C  T  C  C  V  S  *  C  N  Y  D  S  L  F  S  N  L  *  L  F

19021   TTTTGTAAATCTGTTAATTGGAATTTAGAGTATCCAATAATTTCTAATGAGGTCAGTATA   19080
        F  C  K  S  V  N  W  N  L  E  Y  P  I  I  S  N  E  V  S  I
         F  V  N  L  L  I  G  I  *  S  I  Q  *  F  L  M  R  S  V  *
          L  *  I  C  *  L  E  F  R  V  S  N  N  F  *  *  G  Q  Y  K

19081   AATACATCTTGTAGGTTATTGCAGCGTGTCATGCTTAAAGCTGCCATGCTATGTAATAGA   19140
        N  T  S  C  R  L  L  Q  R  V  M  L  K  A  A  M  L  C  N  R
         I  H  L  V  G  Y  C  S  V  S  C  L  K  L  P  C  Y  V  I  D
          Y  I  L  *  V  I  A  A  C  H  A  *  S  C  H  A  M  *  *  I

19141   TACAACTTATGTTATGACATAGGCAATCCTAAAGGTTTAGCTTGTGTCAAAGATTATGAA   19200
        Y  N  L  C  Y  D  I  G  N  P  K  G  L  A  C  V  K  D  Y  E
         T  T  Y  V  M  T  *  A  I  L  K  V  *  L  V  S  K  I  M  N
          Q  L  M  L  *  H  R  Q  S  *  R  F  S  L  C  Q  R  L  *  I

19201   TTTAAATTTTATGATGCTTTTCCTGTAGCCAAGTCTGTTAAACAGTTATTTTATGTCTAT   19260
        F  K  F  Y  D  A  F  P  V  A  K  S  V  K  Q  L  F  Y  V  Y
         L  N  F  M  M  L  F  L  *  P  S  L  L  N  S  Y  F  M  S  M
          *  I  L  *  C  F  S  C  S  Q  V  C  *  T  V  I  L  C  L  *

19261   GATGTGCATAAAGATAATTTTAAAGATGGTTTATGTATGTTTTGGAATTGTAATGTTGAT   19320
        D  V  H  K  D  N  F  K  D  G  L  C  M  F  W  N  C  N  V  D
         M  C  I  K  I  I  L  K  M  V  Y  V  C  F  G  I  V  M  L  I
          C  A  *  R  *  F  *  R  W  F  M  Y  V  L  E  L  *  C  *  *

19321   AAATATCCATCTAATTCAATTGTTTGTAGATTTGACACTCGAGTGTTAAATAAATTAAAC   19380
        K  Y  P  S  N  S  I  V  C  R  F  D  T  R  V  L  N  K  L  N
         N  I  H  L  I  Q  L  F  V  D  L  T  L  E  C  *  I  N  *  T
          I  S  I  *  F  N  C  L  *  I  *  H  S  S  V  K  *  I  K  P

19381   CTTCCTGGATGTAATGGTGGTAGTTTGTATGTTAATAAACATGCATTCCATACTAATCCT   19440
        L  P  G  C  N  G  G  S  L  Y  V  N  K  H  A  F  H  T  N  P
         F  L  D  V  M  V  V  V  C  M  L  I  N  M  H  S  I  L  I  L
          S  W  M  *  W  W  *  F  V  C  *  *  T  C  I  P  Y  *  S  F
```

FIG. 2 CONT.

```
19441  TTTACTAGAACTGTTTTTGAAAATCTTAAGCCTATGCCTTTTTTCTATTATTCAGATACG  19500
       F  T  R  T  V  F  E  N  L  K  P  M  P  F  F  Y  Y  S  D  T
        L  L  E  L  F  L  K  I  L  S  L  C  L  F  S  I  I  Q  I  R
         Y  *  N  C  F  *  K  S  *  A  Y  A  F  F  L  L  F  R  Y  A

19501  CCTTGTGTGTACGTAGATGGTTTAGAATCTAAACAAGTTGATTACGTTCCTTTAAGAAGC  19560
       P  C  V  Y  V  D  G  L  E  S  K  Q  V  D  Y  V  P  L  R  S
        L  V  C  T  *  M  V  *  N  L  N  K  L  I  T  F  L  *  E  A
         L  C  V  R  R  W  F  R  I  *  T  S  *  L  R  S  F  K  K  R

19561  GCCACTTGTATCACACGGTGTAATCTAGGTGGAGCTGTTTGTTCAAAGCATGCTGAAGAA  19620
       A  T  C  I  T  R  C  N  L  G  G  A  V  C  S  K  H  A  E  E
        P  L  V  S  H  G  V  I  *  V  E  L  F  V  Q  S  M  L  K  N
         H  L  Y  H  T  V  *  S  R  W  S  C  L  F  K  A  C  *  R  I

19621  TATTGTAACTACCTTGAGTCTTATAATATAGTTACTACAGCAGGCTTTACTTTTTGGGTT  19680
       Y  C  N  Y  L  E  S  Y  N  I  V  T  T  A  G  F  T  F  W  V
        I  V  T  T  L  S  L  I  I  *  L  L  Q  Q  A  L  L  F  G  F
         L  *  L  P  *  V  L  *  Y  S  Y  Y  S  R  L  Y  F  L  G  L

19681  TATAAGAATTTTGATTTTTATAATTTATGGAACACTTTTACTACGTTACAGAGTTTAGAA  19740
       Y  K  N  F  D  F  Y  N  L  W  N  T  F  T  T  L  Q  S  L  E
        I  R  I  L  I  F  I  I  Y  G  T  L  L  L  R  Y  R  V  *  K
         *  E  F  *  F  L  *  F  M  E  H  F  Y  Y  V  T  E  F  R  K

19741  AACGTAATATATAACTTGGTTAATGTTGGTCATTATGATGGACGTACAGGTGAATTACCT  19800
       N  V  I  Y  N  L  V  N  V  G  H  Y  D  G  R  T  G  E  L  P
        T  *  Y  I  T  W  L  M  L  V  I  M  M  D  V  Q  V  N  Y  L
         R  N  I  *  L  G  *  C  W  S  L  *  W  T  Y  R  *  I  T  L

19801  TGTGCTATTATGAATGACAAAGTTGTTGTTAAGATTAATAATGTAGATACTGTTATTTTT  19860
       C  A  I  M  N  D  K  V  V  V  K  I  N  N  V  D  T  V  I  F
        V  L  L  *  M  T  K  L  L  L  R  L  I  M  *  I  L  L  F  L
         C  Y  Y  E  *  Q  S  C  C  *  D  *  *  C  R  Y  C  Y  F  *

19861  AAAAATAATACATCATTTCCTACTAATATAGCTGTTGAATTGTTTACAAAACGTAGTATC  19920
       K  N  N  T  S  F  P  T  N  I  A  V  E  L  F  T  K  R  S  I
        K  I  I  H  H  F  L  L  I  *  L  L  N  C  L  Q  N  V  V  S
         K  *  Y  I  I  S  Y  *  Y  S  C  *  I  V  Y  K  T  *  Y  P

19921  CGGCACCACCCTGAACTTAAGATTCTTAGAAATTTGAACATTGATATTTGTTGGAAGCAT  19980
       R  H  H  P  E  L  K  I  L  R  N  L  N  I  D  I  C  W  K  H
        G  T  T  L  N  L  R  F  L  E  I  *  T  L  I  F  V  G  S  M
         A  P  P  *  T  *  D  S  *  K  F  E  H  *  Y  L  L  E  A  C
```

FIG. 2 CONT.

```
19981  GTCCTGTGGGATTATGTTAAAGATAGTTTGTTTTGTAGTTCCACTTATGGTGTTTGTAAA  20040
       V  L  W  D  Y  V  K  D  S  L  F  C  S  S  T  Y  G  V  C  K
        S  C  G  I  M  L  K  I  V  C  F  V  V  P  L  M  V  F  V  N
         P  V  G  L  C  *  R  *  F  V  L  *  F  H  L  W  C  L  *  I

20041  TACACAGATTTGAAGTTCATCGAAAATTTGAATATACTTTTTGATGGTCGTGACACTGGC  20100
       Y  T  D  L  K  F  I  E  N  L  N  I  L  F  D  G  R  D  T  G
        T  Q  I  *  S  S  S  K  I  *  I  Y  F  L  M  V  V  T  L  A
         H  R  F  E  V  H  R  K  F  E  Y  T  F  *  W  S  *  H  W  R

20101  GCTTTAGAAGCTTTTAGAAAAGCAAGAAATGGTGTTTTTATTAGTACTGAAAAATTAAGT  20160
       A  L  E  A  F  R  K  A  R  N  G  V  F  I  S  T  E  K  L  S
        L  *  K  L  L  E  K  Q  E  M  V  F  L  L  V  L  K  N  *  V
         F  R  S  F  *  K  S  K  K  W  C  F  Y  *  Y  *  K  I  K  *

20161  AGGTTATCAATGATTAAAGGTCCGCAACGAGCTGATTTAAATGGTGTGATTGTGGATAAA  20220
       R  L  S  M  I  K  G  P  Q  R  A  D  L  N  G  V  I  V  D  K
        G  Y  Q  *  L  K  V  R  N  E  L  I  *  M  V  *  L  W  I  K
         V  I  N  D  *  R  S  A  T  S  *  F  K  W  C  D  C  G  *  S

20221  GTTGGAGAACTCAAAGTTGAGTTTTGGTTCGCTATGAGAAAAGATGGTGACGATGTTATC  20280
       V  G  E  L  K  V  E  F  W  F  A  M  R  K  D  G  D  D  V  I
        L  E  N  S  K  L  S  F  G  S  L  *  E  K  M  V  T  M  L  S
         W  R  T  Q  S  *  V  L  V  R  Y  E  K  R  W  *  R  C  Y  L

20281  TTCAGCCGAACAGACAGCCTATGCTCAAGCCATTACTGGAGCCCACAAGGTAATCTAGGT  20340
       F  S  R  T  D  S  L  C  S  S  H  Y  W  S  P  Q  G  N  L  G
        S  A  E  Q  T  A  Y  A  Q  A  I  T  G  A  H  K  V  I  *  V
         Q  P  N  R  Q  P  M  L  K  P  L  L  E  P  T  R  *  S  R  W

20341  GGTAATTGCGCGGGTAATGTCATTGGTAATGATGCTCTAACACGTTTTACTATCTTTACT  20400
       G  N  C  A  G  N  V  I  G  N  D  A  L  T  R  F  T  I  F  T
        V  I  A  R  V  M  S  L  V  M  M  L  *  H  V  L  L  S  L  L
         *  L  R  G  *  C  H  W  *  *  C  S  N  T  F  Y  Y  L  Y  S

20401  CAGAGTCGTGTATTGTCAAGTTTTGAACCTCGCTCAGATTTAGAACGGGATTTTATTGAT  20460
       Q  S  R  V  L  S  S  F  E  P  R  S  D  L  E  R  D  F  I  D
        R  V  V  Y  C  Q  V  L  N  L  A  Q  I  *  N  G  I  L  L  I
         E  S  C  I  V  K  F  *  T  S  L  R  F  R  T  G  F  Y  *  Y

20461  ATGGATGATAATCTGTTTATTGCTAAATATGGTTTAGAAGACTATGCATTTGATCATATA  20520
       M  D  D  N  L  F  I  A  K  Y  G  L  E  D  Y  A  F  D  H  I
        W  M  I  I  C  L  L  L  N  M  V  *  K  T  M  H  L  I  I  *
         G  *  *  S  V  Y  C  *  I  W  F  R  R  L  C  I  *  S  Y  S
```

FIG. 2 CONT.

```
20521   GTTTATGGTAGTTTTAACCATAAAGTTATAGGAGGTTTGCATTTGCTTATAGGCTTATTT   20580
        V  Y  G  S  F  N  H  K  V  I  G  G  L  H  L  L  I  G  L  F
         F  M  V  V  L  T  I  K  L  *  E  V  C  I  C  L  *  A  Y  F
          L  W  *  F  *  P  *  S  Y  R  R  F  A  F  A  Y  R  L  I  S

20581   CGTAGGAAAAAAAAATCTAATTTGTTAATTCAAGAGTTTTTACAGTATGATTCTAGTATT   20640
        R  R  K  K  K  S  N  L  L  I  Q  E  F  L  Q  Y  D  S  S  I
         V  G  K  K  N  L  I  C  *  F  K  S  F  Y  S  M  I  L  V  F
          *  E  K  K  I  *  F  V  N  S  R  V  F  T  V  *  F  *  Y  S

20641   CATTCATATTTTATTACTGATCAGGAGTGTGGTAGTAGTAAGAGTGTTTGTACAGTTATT   20700
        H  S  Y  F  I  T  D  Q  E  C  G  S  S  K  S  V  C  T  V  I
         I  H  I  L  L  L  I  R  S  V  V  V  V  R  V  F  V  Q  L  L
          F  I  F  Y  Y  *  S  G  V  W  *  *  *  E  C  L  Y  S  Y  *

20701   GATTTATTATTAGATGATTTTGTTTCTATTGTTAAGTCATTAAATTTGAGTTGTGTTAGT   20760
        D  L  L  L  D  D  F  V  S  I  V  K  S  L  N  L  S  C  V  S
         I  Y  Y  *  M  I  L  F  L  L  L  S  H  *  I  *  V  V  L  V
          F  I  I  R  *  F  C  F  Y  C  *  V  I  K  F  E  L  C  *  *

20761   AAAGTTGTTAATATTAATGTTGATTTTAAGGATTTTCAATTTATGTTGTGGTGTAATGAT   20820
        K  V  V  N  I  N  V  D  F  K  D  F  Q  F  M  L  W  C  N  D
         K  L  L  I  L  M  L  I  L  R  I  F  N  L  C  C  G  V  M  I
          S  C  *  Y  *  C  *  F  *  G  F  S  I  Y  V  V  V  *  *  *

20821   AATAAAATTATGACTTTTTATCCTAAAATGCAAGCCACTAATGATTGGAAACCTGGCTAT   20880
        N  K  I  M  T  F  Y  P  K  M  Q  A  T  N  D  W  K  P  G  Y
         I  K  L  *  L  F  I  L  K  C  K  P  L  M  I  G  N  L  A  I
          *  N  Y  D  F  L  S  *  N  A  S  H  *  *  L  E  T  W  L  F

20881   TCTATGCCTGTTTTGTATAAGTATTTGAATGTTCCATTAGAGAGAGTCTCTTTATGGAAT   20940
        S  M  P  V  L  Y  K  Y  L  N  V  P  L  E  R  V  S  L  W  N
         L  C  L  F  C  I  S  I  *  M  F  H  *  R  E  S  L  Y  G  I
          Y  A  C  F  V  *  V  F  E  C  S  I  R  E  S  L  F  M  E  L

20941   TATGGTAAACCTATTAATTTGCCTACAGGCTGTATGATGAATGTTGCTAAGTACACTCAA   21000
        Y  G  K  P  I  N  L  P  T  G  C  M  M  N  V  A  K  Y  T  Q
         M  V  N  L  L  I  C  L  Q  A  V  *  *  M  L  L  S  T  L  N
          W  *  T  Y  *  F  A  Y  R  L  Y  D  E  C  C  *  V  H  S  I

21001   TTATGTCAGTATTTGAATACTACAACATTAGCTGTTCCTGTTAATATGCGTGTTTTACAT   21060
        L  C  Q  Y  L  N  T  T  T  L  A  V  P  V  N  M  R  V  L  H
         Y  V  S  I  *  I  L  Q  H  *  L  F  L  L  I  C  V  F  Y  I
          M  S  V  F  E  Y  Y  N  I  S  C  S  C  *  Y  A  C  F  T  F
```

FIG. 2 CONT.

```
21061   TTAGGTGCAGGGTCTGATAAAGAAGTAGCTCCAGGTTCTGCTGTTTTAAGACAGTGGTTA   21120
        L  G  A  G  S  D  K  E  V  A  P  G  S  A  V  L  R  Q  W  L
         *  V  Q  G  L  I  K  K  *  L  Q  V  L  L  F  *  D  S  G  Y
          R  C  R  V  *  *  R  S  S  S  R  F  C  C  F  K  T  V  V  T

21121   CCATCTGGTAGTATTCTTGTAGATAATGATTTAAACCCATTTGTTAGCGATAGTTTAGTT   21180
        P  S  G  S  I  L  V  D  N  D  L  N  P  F  V  S  D  S  L  V
         H  L  V  V  F  L  *  I  M  I  *  T  H  L  L  A  I  V  *  L
          I  W  *  Y  S  C  R  *  *  F  K  P  I  C  *  R  *  F  S  Y

21181   ACTTATTTTGGAGATTGTATGACTTTACCATTTGATTGTCATTGGGATTTGATAATATCT   21240
        T  Y  F  G  D  C  M  T  L  P  F  D  C  H  W  D  L  I  I  S
         L  I  L  E  I  V  *  L  Y  H  L  I  V  I  G  I  *  *  Y  L
          L  F  W  R  L  Y  D  F  T  I  *  L  S  L  G  F  D  N  I  *

21241   GATATGTATGATCCTCTTACTAAAAATATTGGTGATTATAATGTGAGTAAGGATGGGTTT   21300
        D  M  Y  D  P  L  T  K  N  I  G  D  Y  N  V  S  K  D  G  F
         I  C  M  I  L  L  L  K  I  L  V  I  I  M  *  V  R  M  G  F
          Y  V  *  S  S  Y  *  K  Y  W  *  L  *  C  E  *  G  W  V  F

21301   TTTACTTACATTTGTCATTTAATTCGTGATAAATTATCTTTGGGTGGTAGTGTAGCTATA   21360
        F  T  Y  I  C  H  L  I  R  D  K  L  S  L  G  G  S  V  A  I
         L  L  T  F  V  I  *  F  V  I  N  Y  L  W  V  V  V  *  L  *
          Y  L  H  L  S  F  N  S  *  *  I  I  F  G  W  *  C  S  Y  K

21361   AAAATTACAGAGTTTTCTTGGAATGCTGATTTATATAAATTAATGAGTTGTTTTGCATTT   21420
        K  I  T  E  F  S  W  N  A  D  L  Y  K  L  M  S  C  F  A  F
         K  L  Q  S  F  L  G  M  L  I  Y  I  N  *  *  V  V  L  H  F
          N  Y  R  V  F  L  E  C  *  F  I  *  I  N  E  L  F  C  I  L

21421   TGGACAGTTTTTTGTACTAATGTAAATGCTTCTTCTAGTGAAGGGTTTTTAATAGGTATA   21480
        W  T  V  F  C  T  N  V  N  A  S  S  S  E  G  F  L  I  G  I
         G  Q  F  F  V  L  M  *  M  L  L  L  V  K  G  F  *  *  V  *
          D  S  F  L  Y  *  C  K  C  F  F  *  *  R  V  F  N  R  Y  K

21481   AATTACCTGGGTAAATCTTCTTTTGAAATAGATGGCAATGTTATGCATGCTAACTATTTG   21540
        N  Y  L  G  K  S  S  F  E  I  D  G  N  V  M  H  A  N  Y  L
         I  T  W  V  N  L  L  L  K  *  M  A  M  L  C  M  L  T  I  C
          L  P  G  *  I  F  F  *  N  R  W  Q  C  Y  A  C  *  L  F  V

21541   TTTTGGAGAAATAGTACAACATGGAATGGCGGTGCTTATAGTTTATTTGATATGACTAAA   21600
        F  W  R  N  S  T  T  W  N  G  G  A  Y  S  L  F  D  M  T  K
         F  G  E  I  V  Q  H  G  M  A  V  L  I  V  Y  L  I  *  L  N
          L  E  K  *  Y  N  M  E  W  R  C  L  *  F  I  *  Y  D  *  I
```

FIG. 2 CONT.

```
21601  TTTTCTTTGAAATTGGCTGGCACTGCTGTTGTTAATTTAAGACCAGATCAATTAAATGAT  21660
       F  S  L  K  L  A  G  T  A  V  V  N  L  R  P  D  Q  L  N  D
        F  L  *  N  W  L  A  L  L  L  L  I  *  D  Q  I  N  *  M  I
         F  F  E  I  G  W  H  C  C  C  *  F  K  T  R  S  I  K  *  F

21661  TTAGTTTATTCTCTTATTGAAAGAGGTAAATTATTAGTTCGCGATACGCGTAAAGAGATT  21720
       L  V  Y  S  L  I  E  R  G  K  L  L  V  R  D  T  R  K  E  I
        *  F  I  L  L  L  K  E  V  N  Y  *  F  A  I  R  V  K  R  F
         S  L  F  S  Y  *  K  R  *  I  I  S  S  R  Y  A  *  R  D  F

21721  TTTGTTGGTGATAGTCTTGTAAATACTTGTTAGATCTCATTAAATCTAAACTATGTTAAT  21780
       F  V  G  D  S  L  V  N  T  C  *  I  S  L  N  L  N  Y  V  N
        L  L  V  I  V  L  *  I  L  V  R  S  H  *  I  *  T  M  L  I
         C  W  *  *  S  C  K  Y  L  L  D  L  I  K  S  K  L  C  *  L

21781  TATTTTTTTATTTTTTTATTTCTGTTATGGTTTTAATGAACCTCTTAATGTTGTGTCTCA  21840
       Y  F  F  I  F  L  F  L  L  W  F  *  *  T  S  *  C  C  V  S
        I  F  L  F  F  Y  F  C  Y  G  F  N  E  P  L  N  V  V  S  H
         F  F  Y  F  F  I  S  V  M  V  L  M  N  L  L  M  L  C  L  I

21841  TTTAAACCATGACTGGTTTTTATTTGGTGATAGTCGTTCTGATTGTAACCATATTAATAA  21900
       F  K  P  *  L  V  F  I  W  *  *  S  F  *  L  *  P  Y  *  *
        L  N  H  D  W  F  L  F  G  D  S  R  S  D  C  N  H  I  N  N
         *  T  M  T  G  F  Y  L  V  I  V  V  L  I  V  T  I  L  I  I

21901  TTTAAAAATTAAAAATTTTGATTATTTGGATATTCACCCTAGTTTGTGCAACAATGGTAA  21960
       F  K  N  *  K  F  *  L  F  G  Y  S  P  *  F  V  Q  Q  W  *
        L  K  I  K  N  F  D  Y  L  D  I  H  P  S  L  C  N  N  G  K
         *  K  L  K  I  L  I  I  W  I  F  T  L  V  C  A  T  M  V  R

21961  GATTTCATCTAGTGCCGGTGATTCTATTTTAAGAGTTTTCATTTCACTCGATTTTATAA  22020
       D  F  I  *  C  R  *  F  Y  F  *  E  F  S  F  H  S  I  L  *
        I  S  S  S  A  G  D  S  I  F  K  S  F  H  F  T  R  F  Y  N
         F  H  L  V  P  V  I  L  F  L  R  V  F  I  S  L  D  F  I  I

22021  TTACACTGGCGAAGGTGATCAAATTATTTTTTATGAGGGTGTTAATTTTAATCCTTATCA  22080
       L  H  W  R  R  *  S  N  Y  F  L  *  G  C  *  F  *  S  L  S
        Y  T  G  E  G  D  Q  I  I  F  Y  E  G  V  N  F  N  P  Y  H
         T  L  A  K  V  I  K  L  F  F  M  R  V  L  I  L  I  L  I  I

22081  TAGATTTAAGTGTTTTCCTAATGGTAGTAATGATGTATGGCTTCTTAACAAGGTAAGATT  22140
       *  I  *  V  F  S  *  W  *  *  *  C  M  A  S  *  Q  G  K  I
        R  F  K  C  F  P  N  G  S  N  D  V  W  L  L  N  K  V  R  F
         D  L  S  V  F  L  M  V  V  M  M  Y  G  F  L  T  R  *  D  F
```

FIG. 2 CONT.

```
22141  TTATCGTGCCTTATATTCTAATATGGCCTTTTTTCGTTATCTTACTTTTGTTGATATTCC  22200
       L  S  C  L  I  F  *  Y  G  L  F  S  L  S  Y  F  C  *  Y  S
        Y  R  A  L  Y  S  N  M  A  F  F  R  Y  L  T  F  V  D  I  P
         I  V  P  Y  I  L  I  W  P  F  F  V  I  L  L  L  L  I  F  L

22201  TTATAATGTTTCTCTTTCTAAGTTTAATTCTTGTAAAAGTGATATTTTATCACTTAACAA  22260
       L  *  C  F  S  F  *  V  *  F  L  *  K  *  Y  F  I  T  *  Q
        Y  N  V  S  L  S  K  F  N  S  C  K  S  D  I  L  S  L  N  N
         I  M  F  L  F  L  S  L  I  L  V  K  V  I  F  Y  H  L  T  I

22261  TCCTATTTTTATTAATTATTCTAAGGAAGTTTATTTTACTTTATTAGGTTGTTCTCTTTA  22320
       S  Y  F  Y  *  L  F  *  G  S  L  F  Y  F  I  R  L  F  S  L
        P  I  F  I  N  Y  S  K  E  V  Y  F  T  L  L  G  C  S  L  Y
         L  F  L  L  I  I  L  R  K  F  I  L  L  Y  *  V  V  L  F  I

22321  TTTAGTACCGCTTTGCCTTTTTAAATCTAACTTTAGTCAGTACTATTATAACATAGATAC  22380
       F  S  T  A  L  P  F  *  I  *  L  *  S  V  L  L  *  H  R  Y
        L  V  P  L  C  L  F  K  S  N  F  S  Q  Y  Y  Y  N  I  D  T
         *  Y  R  F  A  F  L  N  L  T  L  V  S  T  I  I  T  *  I  L

22381  TGGCTCTGTTTATGGTTTTTCTAATGTTGTTTATCCTGATTTAGACTGTATTTATATTTC  22440
       W  L  C  L  W  F  F  *  C  C  L  S  *  F  R  L  Y  L  Y  F
        G  S  V  Y  G  F  S  N  V  V  Y  P  D  L  D  C  I  Y  I  S
         A  L  F  M  V  F  L  M  L  F  I  L  I  *  T  V  F  I  F  L

22441  TCTTAAACCAGGTTCTTATAAAGTTTCCACCACTGCACCTTTTTTATCCTTACCTACTAA  22500
       S  *  T  R  F  L  *  S  F  H  H  C  T  F  F  I  L  T  Y  *
        L  K  P  G  S  Y  K  V  S  T  T  A  P  F  L  S  L  P  T  K
         L  N  Q  V  L  I  K  F  P  P  L  H  L  F  Y  P  Y  L  L  K

22501  AGCTCTCTGTTTTGATAAATCTAAACAATTTGTACCTGTACAGGTTGTTGATTCTAGATG  22560
       S  S  L  F  *  *  I  *  T  I  C  T  C  T  G  C  *  F  *  M
        A  L  C  F  D  K  S  K  Q  F  V  P  V  Q  V  V  D  S  R  W
         L  S  V  L  I  N  L  N  N  L  Y  L  Y  R  L  L  I  L  D  G

22561  GAACAACGAGCGTGCCTCAGATATTTCTTTATCTGTTGCATGTCAATTGCCATATTGTTA  22620
       E  Q  R  A  C  L  R  Y  F  F  I  C  C  M  S  I  A  I  L  L
        N  N  E  R  A  S  D  I  S  L  S  V  A  C  Q  L  P  Y  C  Y
         T  T  S  V  P  Q  I  F  L  Y  L  L  H  V  N  C  H  I  V  I

22621  TTTTCGCAATTCTTCTGCTAATTATGTTGGCAAGTATGATATTAACCACGGTGATAGTGG  22680
       F  S  Q  F  F  C  *  L  C  W  Q  V  *  Y  *  P  R  *  *  W
        F  R  N  S  S  A  N  Y  V  G  K  Y  D  I  N  H  G  D  S  G
         F  A  I  L  L  L  I  M  L  A  S  M  I  L  T  T  V  I  V  V
```

FIG. 2 CONT.

```
22681   TTTTATTTCTATTTTATCTGGTCTTTTATATAATGTTTCTTGTATTTCATATTATGGTGT   22740
        F  Y  F  Y  F  I  W  S  F  I  *  C  F  L  Y  F  I  L  W  C
         F  I  S  I  L  S  G  L  L  Y  N  V  S  C  I  S  Y  Y  G  V
          L  F  L  F  Y  L  V  F  Y  I  M  F  L  V  F  H  I  M  V  Y

22741   ATTTTTATATGATAATTTTACATCCATTTGGCCCTATTATTCTTTTGGTAGGTGTCCTAC   22800
        I  F  I  *  *  F  Y  I  H  L  A  L  L  F  F  W  *  V  S  Y
         F  L  Y  D  N  F  T  S  I  W  P  Y  Y  S  F  G  R  C  P  T
          F  Y  M  I  I  L  H  P  F  G  P  I  I  L  L  V  G  V  L  H

22801   ATCTTCTATTATTAAACATCCAATTTGTGTTTATGATTTTTTGCCTATTATTTTACAAGG   22860
        I  F  Y  Y  *  T  S  N  L  C  L  *  F  F  A  Y  Y  F  T  R
         S  S  I  I  K  H  P  I  C  V  Y  D  F  L  P  I  I  L  Q  G
          L  L  L  L  N  I  Q  F  V  F  M  I  F  C  L  L  F  Y  K  V

22861   TATTTTATTATGTTTAGCTTTACTTTTTGTTGTTTTTCTATTATTTTTGTTATATAACGA   22920
        Y  F  I  M  F  S  F  T  F  C  C  F  S  I  I  F  V  I  *  R
         I  L  L  C  L  A  L  L  F  V  V  F  L  L  F  L  L  Y  N  D
          F  Y  Y  V  *  L  Y  F  L  L  F  F  Y  Y  F  C  Y  I  T  I

22921   TAAATCTCATTAAATCTAAACATGTTATTAATTATTTTTATTTTGCCTACAACATTAGCT   22980
        *  I  S  L  N  L  N  M  L  L  I  I  F  I  L  P  T  T  L  A
         K  S  H  *  I  *  T  C  Y  *  L  F  L  F  C  L  Q  H  *  L
          N  L  I  K  S  K  H  V  I  N  Y  F  Y  F  A  Y  N  I  S  C

22981   GTTATAGGTGATTTTAATTGTACTAATTTTGCTATTAATGATTTAAACACCACAGTTCCT   23040
        V  I  G  D  F  N  C  T  N  F  A  I  N  D  L  N  T  T  V  P
         L  *  V  I  L  I  V  L  I  L  L  L  M  I  *  T  P  Q  F  L
          Y  R  *  F  *  L  Y  *  F  C  Y  *  *  F  K  H  H  S  S  S

23041   CGCATAAGTGAGTATGTTGTGGATGTTTCTTATGGTTTGGGTACATATTATATACTTGAT   23100
        R  I  S  E  Y  V  V  D  V  S  Y  G  L  G  T  Y  Y  I  L  D
         A  *  V  S  M  L  W  M  F  L  M  V  W  V  H  I  I  Y  L  I
          H  K  *  V  C  C  G  C  F  L  W  F  G  Y  I  L  Y  T  *  S

23101   CGTGTTTATTTAAATACTACTATATTATTTACTGGTTATTTCCCTAAATCTGGTGCCAAT   23160
        R  V  Y  L  N  T  T  I  L  F  T  G  Y  F  P  K  S  G  A  N
         V  F  I  *  I  L  L  Y  Y  L  L  V  I  S  L  N  L  V  P  I
          C  L  F  K  Y  Y  Y  I  I  Y  W  L  F  P  *  I  W  C  Q  F

23161   TTTAGGGATCTATCTTTAAAAGGTACTACATATTTGAGTACTCTTTGGTATCAGAAACCC   23220
        F  R  D  L  S  L  K  G  T  T  Y  L  S  T  L  W  Y  Q  K  P
         L  G  I  Y  L  *  K  V  L  H  I  *  V  L  F  G  I  R  N  P
          *  G  S  I  F  K  R  Y  Y  I  F  E  Y  S  L  V  S  E  T  L
```

FIG. 2 CONT.

```
23221  TTTTTATCTGATTTTAATAATGGTATTTTTTCTAGAGTTAAGAATACTAAGTTGTATGTT  23280
       F  L  S  D  F  N  N  G  I  F  S  R  V  K  N  T  K  L  Y  V
        F  Y  L  I  L  I  M  V  F  F  L  E  L  R  I  L  S  C  M  L
         F  I  *  F  *  *  W  Y  F  F  *  S  *  E  Y  *  V  V  C  *

23281  AATAAAACTTTGTATAGTGAGTTTAGTACTATAGTTATAGGTAGTGTTTTTATTAACAAC  23340
       N  K  T  L  Y  S  E  F  S  T  I  V  I  G  S  V  F  I  N  N
        I  K  L  C  I  V  S  L  V  L  *  L  *  V  V  F  L  L  T  T
         *  N  F  V  *  *  V  *  Y  Y  S  Y  R  *  C  F  Y  *  Q  L

23341  TCTTATACTATTGTTGTTCAACCTCATAATGGTGTTTTGGAGATTACAGCTTGTCAATAC  23400
       S  Y  T  I  V  V  Q  P  H  N  G  V  L  E  I  T  A  C  Q  Y
        L  I  L  L  L  F  N  L  I  M  V  F  W  R  L  Q  L  V  N  T
         L  Y  Y  C  C  S  T  S  *  W  C  F  G  D  Y  S  L  S  I  H

23401  ACTATGTGTGAGTATCCTCATACTATTTGTAAATCTAAAGGTAGTTCTCGTAATGAATCT  23460
       T  M  C  E  Y  P  H  T  I  C  K  S  K  G  S  S  R  N  E  S
        L  C  V  S  I  L  I  L  F  V  N  L  K  V  V  L  V  M  N  L
         Y  V  *  V  S  S  Y  Y  L  *  I  *  R  *  F  S  *  *  I  L

23461  TGGCATTTTGATAAATCTGAACCTTTGTGTCTGTTCAAGAAAAATTTTACTTATAATGTT  23520
       W  H  F  D  K  S  E  P  L  C  L  F  K  K  N  F  T  Y  N  V
        G  I  L  I  N  L  N  L  C  V  C  S  R  K  I  L  L  I  M  F
         A  F  *  *  I  *  T  F  V  S  V  Q  E  K  F  Y  L  *  C  F

23521  TCTACAGATTGGTTGTATTTTCATTTTTATCAAGAACGTGGCACTTTTTATGCTTATTAT  23580
       S  T  D  W  L  Y  F  H  F  Y  Q  E  R  G  T  F  Y  A  Y  Y
        L  Q  I  G  C  I  F  I  F  I  K  N  V  A  L  F  M  L  I  M
         Y  R  L  V  V  F  S  F  L  S  R  T  W  H  F  L  C  L  L  C

23581  GCTGATTCTGGCATGCCTACTACTTTTTTATTTAGTTTGTATCTTGGTACTCTTTTATCT  23640
       A  D  S  G  M  P  T  T  F  L  F  S  L  Y  L  G  T  L  L  S
        L  I  L  A  C  L  L  L  F  Y  L  V  C  I  L  V  L  F  Y  L
         *  F  W  H  A  Y  Y  F  F  I  *  F  V  S  W  Y  S  F  I  S

23641  CATTATTATGTTTTGCCTTTGACTTGTAATGCTATATCTTCTAATACTGATAATGAGACT  23700
       H  Y  Y  V  L  P  L  T  C  N  A  I  S  S  N  T  D  N  E  T
        I  I  M  F  C  L  *  L  V  M  L  Y  L  L  I  L  I  M  R  L
         L  L  C  F  A  F  D  L  *  C  Y  I  F  *  Y  *  *  *  D  F

23701  TTACAATATTGGGTCACACCTTTGTCTAAACGCCAATATCTTCTTAAATTTGACAACCGT  23760
       L  Q  Y  W  V  T  P  L  S  K  R  Q  Y  L  L  K  F  D  N  R
        Y  N  I  G  S  H  L  C  L  N  A  N  I  F  L  N  L  T  T  V
         T  I  L  G  H  T  F  V  *  T  P  I  S  S  *  I  *  Q  P  W
```

FIG. 2 CONT.

```
23761  GGTGTTATTACTAATGCTGTTGATTGTTCTAGTAGTTTCTTTAGCGAGATTCAATGTAAA  23820
       G  V  I  T  N  A  V  D  C  S  S  S  F  F  S  E  I  Q  C  K
        V  L  L  L  M  L  L  I  V  L  V  V  S  L  A  R  F  N  V  K
         C  Y  Y  *  C  C  *  L  F  *  *  F  L  *  R  D  S  M  *  N

23821  ACTAAATCTTTATTACCTAATACTGGTGTTTATGACTTATCTGGTTTTACTGTTAAGCCT  23880
       T  K  S  L  L  P  N  T  G  V  Y  D  L  S  G  F  T  V  K  P
        L  N  L  Y  Y  L  I  L  V  F  M  T  Y  L  V  L  L  L  S  L
         *  I  F  I  T  *  Y  W  C  L  *  L  I  W  F  Y  C  *  A  C

23881  GTTGCAACTGTACATCGTCGTATTCCTGATTTACCTGATTGTGACATTGATAAATGGCTT  23940
       V  A  T  V  H  R  R  I  P  D  L  P  D  C  D  I  D  K  W  L
        L  Q  L  Y  I  V  V  F  L  I  Y  L  I  V  T  L  I  N  G  L
         C  N  C  T  S  S  Y  S  *  F  T  *  L  *  H  *  *  M  A  *

23941  AACAATTTTAATGTACCCTCACCTCTTAATTGGGAACGTAAAATTTTTTCTAATTGCAAC  24000
       N  N  F  N  V  P  S  P  L  N  W  E  R  K  I  F  S  N  C  N
        T  I  L  M  Y  P  H  L  L  I  G  N  V  K  F  F  L  I  A  T
         Q  F  *  C  T  L  T  S  *  L  G  T  *  N  F  F  *  L  Q  L

24001  TTTAATTTGAGTACTTTGCTTCGTTTAGTTCATACTGATTCTTTTTCTTGTAATAATTTT  24060
       F  N  L  S  T  L  L  R  L  V  H  T  D  S  F  S  C  N  N  F
        L  I  *  V  L  C  F  V  *  F  I  L  I  L  F  L  V  I  I  L
         *  F  E  Y  F  A  S  F  S  S  Y  *  F  F  F  L  *  *  F  *

24061  GATGAATCTAAGATATATGGTAGTTGTTTTAAGAGTATTGTTTTAGATAAATTTGCCATA  24120
       D  E  S  K  I  Y  G  S  C  F  K  S  I  V  L  D  K  F  A  I
        M  N  L  R  Y  M  V  V  V  L  R  V  L  F  *  I  N  L  P  Y
         *  I  *  D  I  W  *  L  F  *  E  Y  C  F  R  *  I  C  H  T

24121  CCCAACTCCAGACGATCTGATTTGCAGTTGGGCAGTTCTGGTTTTCTGCAATCTTCTAAT  24180
       P  N  S  R  R  S  D  L  Q  L  G  S  S  G  F  L  Q  S  S  N
        P  T  P  D  D  L  I  C  S  W  A  V  L  V  F  C  N  L  L  I
         Q  L  Q  T  I  *  F  A  V  G  Q  F  W  F  S  A  I  F  *  L

24181  TATAAAATTGACACTACTTCTAGTTCTTGTCAATTGTATTATAGTTTGCCTGCAATTAAT  24240
       Y  K  I  D  T  T  S  S  S  C  Q  L  Y  Y  S  L  P  A  I  N
        I  K  L  T  L  L  L  V  L  V  N  C  I  I  V  C  L  Q  L  M
         *  N  *  H  Y  F  *  F  L  S  I  V  L  *  F  A  C  N  *  C

24241  GTTACTATTAATAATTATAATCCTTCTTCTTGGAATAGAAGGTATGGTTTTAATAATTTT  24300
       V  T  I  N  N  Y  N  P  S  S  W  N  R  R  Y  G  F  N  N  F
        L  L  L  I  I  I  I  L  L  L  G  I  E  G  M  V  L  I  I  L
         Y  Y  *  *  L  *  S  F  F  L  E  *  K  V  W  F  *  *  F  *
```

FIG. 2 CONT.

```
24301  AATTTGAGCTCTCATAGTGTTGTTTACTCACGTTATTGTTTTTCTGTTAATAATACTTTT  24360
       N  L  S  S  H  S  V  V  Y  S  R  Y  C  F  S  V  N  N  T  F
        I  *  A  L  I  V  L  F  T  H  V  I  V  F  L  L  I  I  L  F
         F  E  L  S  *  C  C  L  L  T  L  L  F  F  C  *  *  Y  F  L

24361  TGTCCTTGTGCTAAACCTTCTTTTGCTTCAAGTTGCAAGAGTCATAAACCACCTTCTGCT  24420
       C  P  C  A  K  P  S  F  A  S  S  C  K  S  H  K  P  P  S  A
        V  L  V  L  N  L  L  L  L  Q  V  A  R  V  I  N  H  L  L  L
         S  L  C  *  T  F  F  C  F  K  L  Q  E  S  *  T  T  F  C  F

24421  TCCTGTCCTATTGGTACTAATTATCGTTCTTGTGAGAGTACTACTGTACTCGACCACACT  24480
       S  C  P  I  G  T  N  Y  R  S  C  E  S  T  T  V  L  D  H  T
        P  V  L  L  V  L  I  I  V  L  V  R  V  L  L  Y  S  T  T  L
         L  S  Y  W  Y  *  L  S  F  L  *  E  Y  Y  C  T  R  P  H  *

24481  GACTGGTGTAGGTGTTCTTGTTTACCTGATCCTATAACTGCTTATGACCCTAGGTCTTGT  24540
       D  W  C  R  C  S  C  L  P  D  P  I  T  A  Y  D  P  R  S  C
        T  G  V  G  V  L  V  Y  L  I  L  *  L  L  M  T  L  G  L  V
         L  V  *  V  F  L  F  T  *  S  Y  N  C  L  *  P  *  V  L  F

24541  TCTCAAAAAAAGTCTCTGGTTGGTGTTGGTGAACATTGTGCAGGGTTCGGTGTTGATGAA  24600
       S  Q  K  K  S  L  V  G  V  G  E  H  C  A  G  F  G  V  D  E
        L  K  K  S  L  W  L  V  L  V  N  I  V  Q  G  S  V  L  M  K
         S  K  K  V  S  G  W  C  W  *  T  L  C  R  V  R  C  *  *  R

24601  GAAAAGTGTGGTGTATTGGATGGATCATATAATGTTTCTTGTCTTTGTAGTACTGATGCC  24660
       E  K  C  G  V  L  D  G  S  Y  N  V  S  C  L  C  S  T  D  A
        K  S  V  V  Y  W  M  D  H  I  M  F  L  V  F  V  V  L  M  P
         K  V  W  C  I  G  W  I  I  *  C  F  L  S  L  *  Y  *  C  L

24661  TTTCTAGGTTGGTCTTATGACACTTGCGTCAGTAACAACCGTTGTAATATTTTTTCTAAT  24720
       F  L  G  W  S  Y  D  T  C  V  S  N  N  R  C  N  I  F  S  N
        F  *  V  G  L  M  T  L  A  S  V  T  T  V  V  I  F  F  L  I
         S  R  L  V  L  *  H  L  R  Q  *  Q  P  L  *  Y  F  F  *  F

24721  TTTATTTTAAATGGTATCAATAGTGGTACCACTTGTTCTAATGATTTATTGCAGCCTAAT  24780
       F  I  L  N  G  I  N  S  G  T  T  C  S  N  D  L  L  Q  P  N
        L  F  *  M  V  S  I  V  V  P  L  V  L  M  I  Y  C  S  L  I
         Y  F  K  W  Y  Q  *  W  Y  H  L  F  *  *  F  I  A  A  *  Y

24781  ACTGAAGTTTTTACTGATGTTTGTGTTGATTACGACCTTTATGGTATTACAGGACAAGGT  24840
       T  E  V  F  T  D  V  C  V  D  Y  D  L  Y  G  I  T  G  Q  G
        L  K  F  L  L  M  F  V  L  I  T  T  F  M  V  L  Q  D  K  V
         *  S  F  Y  *  C  L  C  *  L  R  P  L  W  Y  Y  R  T  R  Y
```

FIG. 2 CONT.

```
24841   ATTTTTAAAGAAGTTTCTGCTGTTTATTATAATAGTTGGCAAAATCTTTTGTATGATTCT   24900
        I  F  K  E  V  S  A  V  Y  Y  N  S  W  Q  N  L  L  Y  D  S
         F  L  K  K  F  L  L  F  I  I  I  V  G  K  I  F  C  M  I  L
          F  *  R  S  F  C  C  L  L  *  *  L  A  K  S  F  V  *  F  *

24901   AATGGCAACATTATTGGTTTTAAAGATTTTGTTACTAATAAAACATATAATATTTTCCCT   24960
        N  G  N  I  I  G  F  K  D  F  V  T  N  K  T  Y  N  I  F  P
         M  A  T  L  L  V  L  K  I  L  L  L  I  K  H  I  I  F  S  L
          W  Q  H  Y  W  F  *  R  F  C  Y  *  *  N  I  *  Y  F  P  L

24961   TGTTATGCAGGAAGAGTTTCTGCTGCTTTTCATCAAAATGCTTCCTCTTTGGCTTTACTT   25020
        C  Y  A  G  R  V  S  A  A  F  H  Q  N  A  S  S  L  A  L  L
         V  M  Q  E  E  F  L  L  L  F  I  K  M  L  P  L  W  L  Y  F
          L  C  R  K  S  F  C  C  F  S  S  K  C  F  L  F  G  F  T  L

25021   TATCGTAATTTAAAATGTAGCTATGTTTTGAATAATATTTCTTTAACTACTCAGCCATAT   25080
        Y  R  N  L  K  C  S  Y  V  L  N  N  I  S  L  T  T  Q  P  Y
         I  V  I  *  N  V  A  M  F  *  I  I  F  L  *  L  L  S  H  I
          S  *  F  K  M  *  L  C  F  E  *  Y  F  F  N  Y  S  A  I  F

25081   TTTGATAGTTATCTTGGTTGCGTTTTTAATGCTGATAATTTAACTGATTATTCTGTTTCT   25140
        F  D  S  Y  L  G  C  V  F  N  A  D  N  L  T  D  Y  S  V  S
         L  I  V  I  L  V  A  F  L  M  L  I  I  *  L  I  I  L  F  L
          *  *  L  S  W  L  R  F  *  C  *  *  F  N  *  L  F  C  F  F

25141   TCTTGTGCTCTTCGCATGGGTAGTGGTTTTTGTGTTGATTATAACTCACCTTCTTCTTCC   25200
        S  C  A  L  R  M  G  S  G  F  C  V  D  Y  N  S  P  S  S  S
         L  V  L  F  A  W  V  V  V  F  V  L  I  I  T  H  L  L  L  P
          L  C  S  S  H  G  *  W  F  L  C  *  L  *  L  T  F  F  F  L

25201   TCTTCGCGTCGTAAACGTAGAAGTATTTCTGCTTCTTATCGTTTTGTTACTTTTGAACCC   25260
        S  S  R  R  K  R  R  S  I  S  A  S  Y  R  F  V  T  F  E  P
         L  R  V  V  N  V  E  V  F  L  L  L  I  V  L  L  L  L  N  P
          F  A  S  *  T  *  K  Y  F  C  F  L  S  F  C  Y  F  *  T  L

25261   TTTAATGTCAGTTTTGTTAATGACAGTATTGAGTCTGTGGGTGGTCTTTATGAGATCAAA   25320
        F  N  V  S  F  V  N  D  S  I  E  S  V  G  G  L  Y  E  I  K
         L  M  S  V  L  L  M  T  V  L  S  L  W  V  V  F  M  R  S  K
          *  C  Q  F  C  *  *  Q  Y  *  V  C  G  W  S  L  *  D  Q  N

25321   ATTCCCACTAACTTTACTATAGTTGGTCAAGAGGAATTTATTCAAACTAATTCTCCTAAA   25380
        I  P  T  N  F  T  I  V  G  Q  E  E  F  I  Q  T  N  S  P  K
         F  P  L  T  L  L  *  L  V  K  R  N  L  F  K  L  I  L  L  K
          S  H  *  L  Y  Y  S  W  S  R  G  I  Y  S  N  *  F  S  *  S
```

FIG. 2 CONT.

```
25381     GTTACTATTGATTGTTCTTTATTTGTCTGTTCTAATTATGCAGCTTGCCATGACTTATTG     25440
          V  T  I  D  C  S  L  F  V  C  S  N  Y  A  A  C  H  D  L  L
           L  L  L  I  V  L  Y  L  S  V  L  I  M  Q  L  A  M  T  Y  C
            Y  Y  *  L  F  F  I  C  L  F  *  L  C  S  L  P  *  L  I  V

25441     TCAGAGTATGGCACTTTTTGTGATAATATTAATAGTATTTTAGATGAAGTTAATGGTTTA     25500
          S  E  Y  G  T  F  C  D  N  I  N  S  I  L  D  E  V  N  G  L
           Q  S  M  A  L  F  V  I  I  L  I  V  F  *  M  K  L  M  V  Y
            R  V  W  H  F  L  *  *  Y  *  *  Y  F  R  *  S  *  W  F  T

25501     CTTGATACTACTCAATTGCATGTAGCTGATACTCTTATGCAAGGTGTCACACTTAGCTCC     25560
          L  D  T  T  Q  L  H  V  A  D  T  L  M  Q  G  V  T  L  S  S
           L  I  L  L  N  C  M  *  L  I  L  L  C  K  V  S  H  L  A  P
            *  Y  Y  S  I  A  C  S  *  Y  S  Y  A  R  C  H  T  *  L  Q

25561     AATCTTAATACTAATTTGCATTTTGATGTTGATAATATTAATTTTAAATCCCTAGTTGGA     25620
          N  L  N  T  N  L  H  F  D  V  D  N  I  N  F  K  S  L  V  G
           I  L  I  L  I  C  I  L  M  L  I  I  L  I  L  N  P  *  L  D
            S  *  Y  *  F  A  F  *  C  *  *  Y  *  F  *  I  P  S  W  M

25621     TGTTTAGGTCCACACTGCGGTTCTTCTTCTCGTTCTTTTTTTGAAGATTTATTGTTTGAC     25680
          C  L  G  P  H  C  G  S  S  S  R  S  F  F  E  D  L  L  F  D
           V  *  V  H  T  A  V  L  L  L  V  L  F  L  K  I  Y  C  L  T
            F  R  S  T  L  R  F  F  F  S  F  F  F  *  R  F  I  V  *  Q

25681     AAAGTTAAACTTTCAGATGTTGGTTTTGTTGAAGCTTATAACAATTGTACTGGTGGTAGT     25740
          K  V  K  L  S  D  V  G  F  V  E  A  Y  N  N  C  T  G  G  S
           K  L  N  F  Q  M  L  V  L  L  K  L  I  T  I  V  L  V  V  V
            S  *  T  F  R  C  W  F  C  *  S  L  *  Q  L  Y  W  W  *  *

25741     GAAATTAGAGATCTTCTTTGTGTACAATCCTTTAATGGTATTAAAGTTTTGCCTCCTATT     25800
          E  I  R  D  L  L  C  V  Q  S  F  N  G  I  K  V  L  P  P  I
           K  L  E  I  F  F  V  Y  N  P  L  M  V  L  K  F  C  L  L  F
            N  *  R  S  S  L  C  T  I  L  *  W  Y  *  S  F  A  S  Y  F

25801     TTGTCTGAATCTCAAATTTCTGGTTACACCACAGCCGCTACTGTTGCTGCTATGTTTCCA     25860
          L  S  E  S  Q  I  S  G  Y  T  T  A  A  T  V  A  A  M  F  P
           C  L  N  L  K  F  L  V  T  P  Q  P  L  L  L  L  L  C  F  H
            V  *  I  S  N  F  W  L  H  H  S  R  Y  C  C  C  Y  V  S  T

25861     CCATGGTCAGCAGCAGCTGGCATACCATTTTCTCTTAATGTACAATATAGAATTAATGGT     25920
          P  W  S  A  A  A  G  I  P  F  S  L  N  V  Q  Y  R  I  N  G
           H  G  Q  Q  Q  L  A  Y  H  F  L  L  M  Y  N  I  E  L  M  V
            M  V  S  S  S  W  H  T  I  F  S  *  C  T  I  *  N  *  W  F
```

FIG. 2 CONT.

```
25921   TTGGGTGTTACTATGGATGTTCTTAATAAAAATCAAAAGTTGATAGCTACTGCTTTTAAT   25980
        L  G  V  T  M  D  V  L  N  K  N  Q  K  L  I  A  T  A  F  N
         W  V  L  L  W  M  F  L  I  K  I  K  S  *  *  L  L  L  L  I
          G  C  Y  Y  G  C  S  *  *  K  S  K  V  D  S  Y  C  F  *  *

25981   AATGCTCTTCTTTCTATTCAGAATGGTTTTAGTGCTACCAACTCTGCACTTGCTAAAATA   26040
        N  A  L  L  S  I  Q  N  G  F  S  A  T  N  S  A  L  A  K  I
         M  L  F  F  L  F  R  M  V  L  V  L  P  T  L  H  L  L  K  Y
          C  S  S  F  Y  S  E  W  F  *  C  Y  Q  L  C  T  C  *  N  T

26041   CAAAGTGTTGTTAATTCTAATGCTCAAGCACTTAATAGTTTGTTACAGCAATTATTTAAT   26100
        Q  S  V  V  N  S  N  A  Q  A  L  N  S  L  L  Q  Q  L  F  N
         K  V  L  L  I  L  M  L  K  H  L  I  V  C  Y  S  N  Y  L  I
          K  C  C  *  F  *  C  S  S  T  *  *  F  V  T  A  I  I  *  *

26101   AAATTTGGTGCAATTAGTTCTTCTTTACAAGAAATTTTATCTCGTCTCGATGCTTTAGAG   26160
        K  F  G  A  I  S  S  S  L  Q  E  I  L  S  R  L  D  A  L  E
         N  L  V  Q  L  V  L  L  Y  K  K  F  Y  L  V  S  M  L  *  R
          I  W  C  N  *  F  F  F  T  R  N  F  I  S  S  R  C  F  R  G

26161   GCTCAGGTTCAGATTGATAGGCTTATTAATGGTCGTTTAACTGCTTTAAATGCTTATGTC   26220
        A  Q  V  Q  I  D  R  L  I  N  G  R  L  T  A  L  N  A  Y  V
         L  R  F  R  L  I  G  L  L  M  V  V  *  L  L  *  M  L  M  S
          S  G  S  D  *  *  A  Y  *  W  S  F  N  C  F  K  C  L  C  L

26221   TCTCAACAGCTTAGTGATATTTCTCTTGTAAAATTTGGTGCTGCTTTAGCTATGGAGAAG   26280
        S  Q  Q  L  S  D  I  S  L  V  K  F  G  A  A  L  A  M  E  K
         L  N  S  L  V  I  F  L  L  *  N  L  V  L  L  *  L  W  R  R
          S  T  A  *  *  Y  F  S  C  K  I  W  C  C  F  S  Y  G  E  G

26281   GTTAATGAGTGTGTTAAAAGTCAATCTCCTCGTATTAATTTTTGTGGTAATGGTAATCAT   26340
        V  N  E  C  V  K  S  Q  S  P  R  I  N  F  C  G  N  G  N  H
         L  M  S  V  L  K  V  N  L  L  V  L  I  F  V  V  M  V  I  I
          *  *  V  C  *  K  S  I  S  S  Y  *  F  L  W  *  W  *  S  Y

26341   ATTTTGTCATTAGTTCAAAATGCTCCTTATGGTTTGTTGTTTATGCATTTTAGTTATAAA   26400
        I  L  S  L  V  Q  N  A  P  Y  G  L  L  F  M  H  F  S  Y  K
         F  C  H  *  F  K  M  L  L  M  V  C  C  L  C  I  L  V  I  N
          F  V  I  S  S  K  C  S  L  W  F  V  V  Y  A  F  *  L  *  T

26401   CCTATTTCTTTTAAAACTGTTTTAGTAAGTCCTGGTTTGTGTATATCAGGTGATGTAGGT   26460
        P  I  S  F  K  T  V  L  V  S  P  G  L  C  I  S  G  D  V  G
         L  F  L  L  K  L  F  *  *  V  L  V  C  V  Y  Q  V  M  *  V
          Y  F  F  *  N  C  F  S  K  S  W  F  V  Y  I  R  *  C  R  Y
```

FIG. 2 CONT.

```
26461  ATTGCACCTAAACAAGGGTATTTTATTAAACATAATGATCATTGGATGTTCACTGGTAGT  26520
       I  A  P  K  Q  G  Y  F  I  K  H  N  D  H  W  M  F  T  G  S
        L  H  L  N  K  G  I  L  L  N  I  M  I  I  G  C  S  L  V  V
         C  T  *  T  R  V  F  Y  *  T  *  *  S  L  D  V  H  W  *  F

26521  TCTTACTATTATCCTGAACCAATTTCAGATAAAAATGTTGTTTTTATGAATACTTGTTCT  26580
       S  Y  Y  Y  P  E  P  I  S  D  K  N  V  V  F  M  N  T  C  S
        L  T  I  I  L  N  Q  F  Q  I  K  M  L  F  L  *  I  L  V  L
         L  L  L  S  *  T  N  F  R  *  K  C  C  F  Y  E  Y  L  F  C

26581  GTTAATTTTACTAAAGCGCCTCTTGTTTATTTGAATCATTCTGTACCAAAATTGTCTGAT  26640
       V  N  F  T  K  A  P  L  V  Y  L  N  H  S  V  P  K  L  S  D
        L  I  L  L  K  R  L  L  F  I  *  I  I  L  Y  Q  N  C  L  I
         *  F  Y  *  S  A  S  C  L  F  E  S  F  C  T  K  I  V  *  F

26641  TTTGAATCTGAGTTATCTCATTGGTTTAAAAATCAAACATCCATTGCGCCTAATTTGACT  26700
       F  E  S  E  L  S  H  W  F  K  N  Q  T  S  I  A  P  N  L  T
        L  N  L  S  Y  L  I  G  L  K  I  K  H  P  L  R  L  I  *  L
         *  I  *  V  I  S  L  V  *  K  S  N  I  H  C  A  *  F  D  F

26701  TTAAATCTTCATACTATTAATGCTACTTTTTTAGATTTGTATTATGAGATGAATCTTATT  26760
       L  N  L  H  T  I  N  A  T  F  L  D  L  Y  Y  E  M  N  L  I
        *  I  F  I  L  L  M  L  L  F  *  I  C  I  M  R  *  I  L  F
         K  S  S  Y  Y  *  C  Y  F  F  R  F  V  L  *  D  E  S  Y  S

26761  CAAGAGTCTATTAAGTCTTTGAATAATAGTTATATCAATCTTAAAGATATAGGTACATAT  26820
       Q  E  S  I  K  S  L  N  N  S  Y  I  N  L  K  D  I  G  T  Y
        K  S  L  L  S  L  *  I  I  V  I  S  I  L  K  I  *  V  H  M
         R  V  Y  *  V  F  E  *  *  L  Y  Q  S  *  R  Y  R  Y  I  *

26821  GAAATGTATGTAAAATGGCCTTGGTATGTTTGGCTACTAATTTCTTTTTCATTTATAATA  26880
       E  M  Y  V  K  W  P  W  Y  V  W  L  L  I  S  F  S  F  I  I
        K  C  M  *  N  G  L  G  M  F  G  Y  *  F  L  F  H  L  *  Y
         N  V  C  K  M  A  L  V  C  L  A  T  N  F  F  F  I  Y  N  I

26881  TTCCTTGTATTGCTCTTTTTTATATGTTGTTGTACTGGTTGTGGTTCTGCATGTTTTAGT  26940
       F  L  V  L  L  F  F  I  C  C  C  T  G  C  G  S  A  C  F  S
        S  L  Y  C  S  F  L  Y  V  V  V  L  V  V  V  L  H  V  L  V
         P  C  I  A  L  F  Y  M  L  L  Y  W  L  W  F  C  M  F  *  *

26941  AAATGTCATAATTGTTGTGATGAGTATGGTGGTCATCATGATTTTGTTATCAAAACATCT  27000
       K  C  H  N  C  C  D  E  Y  G  G  H  H  D  F  V  I  K  T  S
        N  V  I  I  V  V  M  S  M  V  V  I  M  I  L  L  S  K  H  L
         M  S  *  L  L  *  *  V  W  W  S  S  *  F  C  Y  Q  N  I  S
```

FIG. 2 CONT.

```
27001   CATGATGATTAGAATCTCTTGTCAGATCTCATTAAATCTAAACTTTATTTATGGACGTTT   27060
        H  D  D  *  N  L  L  S  D  L  I  K  S  K  L  Y  L  W  T  F
         M  M  I  R  I  S  C  Q  I  S  L  N  L  N  F  I  Y  G  R  L
          *  *  L  E  S  L  V  R  S  H  *  I  *  T  L  F  M  D  V  W

27061   GGAGACCTAGCTACACACATTCTCTTGTTATTAGAGAATTTGGTGTTACAAACCTTGAAG   27120
        G  D  L  A  T  H  I  L  L  L  L  E  N  L  V  L  Q  T  L  K
         E  T  *  L  H  T  F  S  C  Y  *  R  I  W  C  Y  K  P  *  R
          R  P  S  Y  T  H  S  L  V  I  R  E  F  G  V  T  N  L  E  D

27121   ATTTGTGTCTAAAGTATAATTACTGTCAACCTATTGTTGGTTACTGTATTGTACCTTTAA   27180
        I  C  V  *  S  I  I  T  V  N  L  L  L  V  T  V  L  Y  L  *
         F  V  S  K  V  *  L  L  S  T  Y  C  W  L  L  Y  C  T  F  K
          L  C  L  K  Y  N  Y  C  Q  P  I  V  G  Y  C  I  V  P  L  N

27181   ATGTTTGGTGTCGCAAGTTTGGCAAATTTGCTTCTCACTTTACATTACGTAGTCACGATA   27240
        M  F  G  V  A  S  L  A  N  L  L  L  T  L  H  Y  V  V  T  I
         C  L  V  S  Q  V  W  Q  I  C  F  S  L  Y  I  T  *  S  R  Y
          V  W  C  R  K  F  G  K  F  A  S  H  F  T  L  R  S  H  D  I

27241   TTTCCCATAGTAATAATTTTGGTGTTGTAACTAGTTTTACTACTTATGGTAATACTGTTT   27300
        F  P  I  V  I  I  L  V  L  *  L  V  L  L  L  M  V  I  L  F
         F  P  *  *  *  F  W  C  C  N  *  F  Y  Y  L  W  *  Y  C  F
          S  H  S  N  N  F  G  V  V  T  S  F  T  T  Y  G  N  T  V  S

27301   CTGAGGCTGTGTCTAGATTAGTTGAATCAGCTTCTGAATTTATTGTTTGGCGTGCAGAGG   27360
        L  R  L  C  L  D  *  L  N  Q  L  L  N  L  L  F  G  V  Q  R
         *  G  C  V  *  I  S  *  I  S  F  *  I  Y  C  L  A  C  R  G
          E  A  V  S  R  L  V  E  S  A  S  E  F  I  V  W  R  A  E  A

27361   CACTTAATAAGTATGGTTGATTTATTTTTCAATGATACTGCTTGGTACATAGGACAGATT   27420
        H  L  I  S  M  V  D  L  F  F  N  D  T  A  W  Y  I  G  Q  I
         T  *  *  V  W  L  I  Y  F  S  M  I  L  L  G  T  *  D  R  F
          L  N  K  Y  G  *  F  I  F  Q  *  Y  C  L  V  H  R  T  D  F

27421   TTAGTTTTAGTTTTATTTTGTCTTATTTCTTTAATCTTTGTTGTTGCTTTTTTAGCAACT   27480
        L  V  L  V  L  F  C  L  I  S  L  I  F  V  V  A  F  L  A  T
         *  F  *  F  Y  F  V  L  F  L  *  S  L  L  L  L  F  *  Q  L
          S  F  S  F  I  L  S  Y  F  F  N  L  C  C  C  F  F  S  N  Y

27481   ATTAAGCTTTGTATGCAACTTTGTGGTTTTTGTAATTTCTTTATTATTTCACCTTCGGCT   27540
        I  K  L  C  M  Q  L  C  G  F  C  N  F  F  I  I  S  P  S  A
         L  S  F  V  C  N  F  V  V  F  V  I  S  L  L  F  H  L  R  L
          *  A  L  Y  A  T  L  W  F  L  *  F  L  Y  Y  F  T  F  G  L
```

FIG. 2 CONT.

```
27541    TACGTTTATAAAAGAGGTATGCAGTTGTATAAGTCTTATAGTGAACAAGTTATACCACCC    27600
         Y  V  Y  K  R  G  M  Q  L  Y  K  S  Y  S  E  Q  V  I  P  P
          T  F  I  K  E  V  C  S  C  I  S  L  I  V  N  K  L  Y  H  P
           R  L  *  K  R  Y  A  V  V  *  V  L  *  *  T  S  Y  T  T  H

27601    ACTTCAGATTATTTAATCTAAATCTAAACATTATGAATAAATCTTTTCTTCCTCAATTTA    27660
         T  S  D  Y  L  I  *  I  *  T  L  *  I  N  L  F  F  L  N  L
          L  Q  I  I  *  S  K  S  K  H  Y  E  *  I  F  S  S  S  I  Y
           F  R  L  F  N  L  N  L  N  I  M  N  K  S  F  L  P  Q  F  T

27661    CTTCTGATCAAGCTGTTACATTCTTAAAAGAATGGAATTTCTCTTTGGGTGTAATACTAC    27720
         L  L  I  K  L  L  H  S  *  K  N  G  I  S  L  W  V  *  Y  Y
          F  *  S  S  C  Y  I  L  K  R  M  E  F  L  F  G  C  N  T  T
           S  D  Q  A  V  T  F  L  K  E  W  N  F  S  L  G  V  I  L  L

27721    TTTTTATTACTATCATATTGCAGTTCGGTTATACGAGCCGTAGTATGTTTGTTTATCTTA    27780
         F  L  L  L  S  Y  C  S  S  V  I  R  A  V  V  C  L  F  I  L
          F  Y  Y  Y  H  I  A  V  R  L  Y  E  P  *  Y  V  C  L  S  Y
           F  I  T  I  I  L  Q  F  G  Y  T  S  R  S  M  F  V  Y  L  I

27781    TCAAGATGATTATTCTTTGGCTTATGTGGCCATTGACTATCACCTTGACTATATTTAATT    27840
         S  R  *  L  F  F  G  L  C  G  H  *  L  S  P  *  L  Y  L  I
          Q  D  D  Y  S  L  A  Y  V  A  I  D  Y  H  L  D  Y  I  *  L
           K  M  I  I  L  W  L  M  W  P  L  T  I  T  L  T  I  F  N  C

27841    GTTTTTATGCTTTGAATAATGCTTTTCTTGCATTTTCTATAGTGTTTACTATTATTTCTA    27900
         V  F  M  L  *  I  M  L  F  L  H  F  L  *  C  L  L  L  F  L
          F  L  C  F  E  *  C  F  S  C  I  F  Y  S  V  Y  Y  Y  F  Y
           F  Y  A  L  N  N  A  F  L  A  F  S  I  V  F  T  I  I  S  I

27901    TTGTTATATGGATTCTTTATTTTGTTAATAGTATTCGGCTTTTTATTAGAACTGGCAGTT    27960
         L  L  Y  G  F  F  I  L  L  I  V  F  G  F  L  L  E  L  A  V
          C  Y  M  D  S  L  F  C  *  *  Y  S  A  F  Y  *  N  W  Q  L
           V  I  W  I  L  Y  F  V  N  S  I  R  L  F  I  R  T  G  S  W

27961    GGTGGAGTTTTAATCCAGAGACCAATAATCTTATGTGTATTGATATGAAAGGCAAGATGT    28020
         G  G  V  L  I  Q  R  P  I  I  L  C  V  L  I  *  K  A  R  C
          V  E  F  *  S  R  D  Q  *  S  Y  V  Y  *  Y  E  R  Q  D  V
           W  S  F  N  P  E  T  N  N  L  M  C  I  D  M  K  G  K  M  F

28021    TTGTTAGGCCAGTTATTGAGGACTATCACACATTAACTGCTACTGTTATTCGTGGTCATC    28080
         L  L  G  Q  L  L  R  T  I  T  H  *  L  L  L  L  F  V  V  I
          C  *  A  S  Y  *  G  L  S  H  I  N  C  Y  C  Y  S  W  S  S
           V  R  P  V  I  E  D  Y  H  T  L  T  A  T  V  I  R  G  H  L
```

FIG. 2 CONT.

```
28081   TTTATATACAGGGTGTCAAACTTGGCACTGGTTATACTCTTTCAGATTTGCCCGTATATG   28140
        F  I  Y  R  V  S  N  L  A  L  V  I  L  F  Q  I  C  P  Y  M
         L  Y  T  G  C  Q  T  W  H  W  L  Y  S  F  R  F  A  R  I  C
          Y  I  Q  G  V  K  L  G  T  G  Y  T  L  S  D  L  P  V  Y  V

28141   TTACTGTAGCTAAGGTGCAAGTACTTTGTACCTATAAACGTGCCTTTTTAGATAAGTTAG   28200
        L  L  *  L  R  C  K  Y  F  V  P  I  N  V  P  F  *  I  S  *
         Y  C  S  *  G  A  S  T  L  Y  L  *  T  C  L  F  R  *  V  R
          T  V  A  K  V  Q  V  L  C  T  Y  K  R  A  F  L  D  K  L  D

28201   ATGTTAATAGTGGTTTTGCTGTTTTTGTTAAGTCTAAAGTTGGTAACTATCGTTTACCGT   28260
        M  L  I  V  V  L  L  F  L  L  S  L  K  L  V  T  I  V  Y  R
         C  *  *  W  F  C  C  F  C  *  V  *  S  W  *  L  S  F  T  V
          V  N  S  G  F  A  V  F  V  K  S  K  V  G  N  Y  R  L  P  S

28261   CTAGTAAACCTAGTGGTATGGATACTGCCTTGTTAAGAGCTTAAATCTAAACTATTAGGA   28320
        L  V  N  L  V  V  W  I  L  P  C  *  E  L  K  S  K  L  L  G
         *  *  T  *  W  Y  G  Y  C  L  V  K  S  L  N  L  N  Y  *  D
          S  K  P  S  G  M  D  T  A  L  L  R  A  *  I  *  T  I  R  M

28321   TGTCTTATACTCCCGGTCATTATGCTGGAAGTAGAAGCTCCTCTGGAAATCGTTCAGGAA   28380
        C  L  I  L  P  V  I  M  L  E  V  E  A  P  L  E  I  V  Q  E
         V  L  Y  S  R  S  L  C  W  K  *  K  L  L  W  K  S  F  R  N
          S  Y  T  P  G  H  Y  A  G  S  R  S  S  S  G  N  R  S  G  I

28381   TCCTCAAGAAAACTTCTTGGGCTGACCAATCTGAGCGAAATTACCAAACCTTTAATAGAG   28440
        S  S  R  K  L  L  G  L  T  N  L  S  E  I  T  K  P  L  I  E
         P  Q  E  N  F  L  G  *  P  I  *  A  K  L  P  N  L  *  *  R
          L  K  K  T  S  W  A  D  Q  S  E  R  N  Y  Q  T  F  N  R  G

28441   GCAGAAAAACCCAACCTAAATTCACTGTGTCTACTCAACCACAAGGAAATACTATCCCAC   28500
        A  E  K  P  N  L  N  S  L  C  L  L  N  H  K  E  I  L  S  H
         Q  K  N  P  T  *  I  H  C  V  Y  S  T  T  R  K  Y  Y  P  T
          R  K  T  Q  P  K  F  T  V  S  T  Q  P  Q  G  N  T  I  P  H

28501   ATTATTCCTGGTTCTCCGGGATCACTCAATTTCAAAAAGGTAGAGACTTTAAATTTTCAG   28560
        I  I  P  G  S  P  G  S  L  N  F  K  K  V  E  T  L  N  F  Q
         L  F  L  V  L  R  D  H  S  I  S  K  R  *  R  L  *  I  F  R
          Y  S  W  F  S  G  I  T  Q  F  Q  K  G  R  D  F  K  F  S  D

28561   ATGGTCAAGGAGTTCCCATTGCTTTCGGAGTACCCCCTTCTGAAGCAAAAGGATATTGGT   28620
        M  V  K  E  F  P  L  L  S  E  Y  P  L  L  K  Q  K  D  I  G
         W  S  R  S  S  H  C  F  R  S  T  P  F  *  S  K  R  I  L  V
          G  Q  G  V  P  I  A  F  G  V  P  P  S  E  A  K  G  Y  W  Y
```

FIG. 2 CONT.

```
28621   ATAGACACAGCCGGCGTTCTTTTAAAACAGCTGATGGTCAACAAAAGCAGTTGTTACCGA   28680
        I  D  T  A  G  V  L  L  K  Q  L  M  V  N  K  S  S  C  Y  R
         *  T  Q  P  A  F  F  *  N  S  *  W  S  T  K  A  V  V  T  E
          R  H  S  R  R  S  F  K  T  A  D  G  Q  Q  K  Q  L  L  P  R

28681   GATGGTATTTCTACTATCTCGGTACCGGCCCATATGCCAATGCATCCTATGGTGAATCCC   28740
        D  G  I  S  T  I  S  V  P  A  H  M  P  M  H  P  M  V  N  P
         M  V  F  L  L  S  R  Y  R  P  I  C  Q  C  I  L  W  *  I  P
          W  Y  F  Y  Y  L  G  T  G  P  Y  A  N  A  S  Y  G  E  S  L

28741   TCGAAGGGGTCTTCTGGGTTGCTAATCACCAAGCTGACACTTCTACTCCCTCCGATGTTT   28800
        S  K  G  S  S  G  L  L  I  T  K  L  T  L  L  L  P  P  M  F
         R  R  G  L  L  G  C  *  S  P  S  *  H  F  Y  S  L  R  C  F
          E  G  V  F  W  V  A  N  H  Q  A  D  T  S  T  P  S  D  V  S

28801   CGTCAAGGGATCCTACTACTCAAGAAGCTATCCCTACTAGGTTTCCGCCTGGTACGATTT   28860
        R  Q  G  I  L  L  L  K  K  L  S  L  L  G  F  R  L  V  R  F
         V  K  G  S  Y  Y  S  R  S  Y  P  Y  *  V  S  A  W  Y  D  F
          S  R  D  P  T  T  Q  E  A  I  P  T  R  F  P  P  G  T  I  L

28861   TGCCTCAAGGCTATTATGTTGAAGGCTCAGGAAGGTCTGCTTCTAATAGTCGACCAGGTT   28920
        C  L  K  A  I  M  L  K  A  Q  E  G  L  L  L  I  V  D  Q  V
         A  S  R  L  L  C  *  R  L  R  K  V  C  F  *  *  S  T  R  F
          P  Q  G  Y  Y  V  E  G  S  G  R  S  A  S  N  S  R  P  G  S

28921   CACGTTCTCAATCACGTGGACCCAATAATCGTTCATTAAGTAGAAGTAATTCTAATTTTA   28980
        H  V  L  N  H  V  D  P  I  I  V  H  *  V  E  V  I  L  I  L
         T  F  S  I  T  W  T  Q  *  S  F  I  K  *  K  *  F  *  F  *
          R  S  Q  S  R  G  P  N  N  R  S  L  S  R  S  N  S  N  F  R

28981   GACATTCAGATTCTATAGTAAAACCTGATATGGCTGATGAGATCGCTAATCTTGTTTTAG   29040
        D  I  Q  I  L  *  *  N  L  I  W  L  M  R  S  L  I  L  F  *
         T  F  R  F  Y  S  K  T  *  Y  G  *  *  D  R  *  S  C  F  S
          H  S  D  S  I  V  K  P  D  M  A  D  E  I  A  N  L  V  L  A

29041   CCAAGCTTGGTAAAGATTCTAAACCTCAGCAAGTCACTAAGCAAAATGCCAAGGAAATCA   29100
        P  S  L  V  K  I  L  N  L  S  K  S  L  S  K  M  P  R  K  S
         Q  A  W  *  R  F  *  T  S  A  S  H  *  A  K  C  Q  G  N  Q
          K  L  G  K  D  S  K  P  Q  Q  V  T  K  Q  N  A  K  E  I  R

29101   GGCATAAAATTTTAACAAAACCTCGCCAAAAGCGAACTCCTAATAAACATTGTAATGTTC   29160
        G  I  K  F  *  Q  N  L  A  K  S  E  L  L  I  N  I  V  M  F
         A  *  N  F  N  K  T  S  P  K  A  N  S  *  *  T  L  *  C  S
          H  K  I  L  T  K  P  R  Q  K  R  T  P  N  K  H  C  N  V  Q
```

FIG. 2 CONT.

```
29161   AACAGTGTTTTGGTAAAAGAGGACCTTCTCAAAATTTTGGTAATGCTGAAATGTTAAAGC   29220
        N  S  V  L  V  K  E  D  L  L  K  I  L  V  M  L  K  C  *  S
         T  V  F  W  *  K  R  T  F  S  K  F  W  *  C  *  N  V  K  A
          Q  C  F  G  K  R  G  P  S  Q  N  F  G  N  A  E  M  L  K  L

29221   TTGGTACTAATGATCCTCAGTTTCCTATTCTTGCAGAATTAGCTCCTACACCAGGTGCTT   29280
        L  V  L  M  I  L  S  F  L  F  L  Q  N  *  L  L  H  Q  V  L
         W  Y  *  *  S  S  V  S  Y  S  C  R  I  S  S  Y  T  R  C  F
          G  T  N  D  P  Q  F  P  I  L  A  E  L  A  P  T  P  G  A  F

29281   TTTTCTTTGGTTCTAAATTAGACTTGGTTAAAAGAGATTCCGAGGCTGACTCACCTGTTA   29340
        F  S  L  V  L  N  *  T  W  L  K  E  I  P  R  L  T  H  L  L
         F  L  W  F  *  I  R  L  G  *  K  R  F  R  G  *  L  T  C  *
          F  F  G  S  K  L  D  L  V  K  R  D  S  E  A  D  S  P  V  K

29341   AAGATGTTTTTGAACTTCATTATTCTGGTTCTATTAGGTTTGATAGTACTTTACCAGGCT   29400
        K  M  F  L  N  F  I  I  L  V  L  L  G  L  I  V  L  Y  Q  A
         R  C  F  *  T  S  L  F  W  F  Y  *  V  *  *  Y  F  T  R  L
          D  V  F  E  L  H  Y  S  G  S  I  R  F  D  S  T  L  P  G  F

29401   TTGAGACAATTATGAAAGTTCTTGAAGAGAATTTAAATGCTTACGTTAATTCTAATCAGA   29460
        L  R  Q  L  *  K  F  L  K  R  I  *  M  L  T  L  I  L  I  R
         *  D  N  Y  E  S  S  *  R  E  F  K  C  L  R  *  F  *  S  E
          E  T  I  M  K  V  L  E  E  N  L  N  A  Y  V  N  S  N  Q  N

29461   ACACTGATTCTGATTCGTTGAGTTCTAAACCTCAGCGTAAAAGAGGTGTTAAACAATTAC   29520
        T  L  I  L  I  R  *  V  L  N  L  S  V  K  E  V  L  N  N  Y
         H  *  F  *  F  V  E  F  *  T  S  A  *  K  R  C  *  T  I  T
          T  D  S  D  S  L  S  S  K  P  Q  R  K  R  G  V  K  Q  L  P

29521   CAGAACAGTTTGACTCTCTTAATTTAAGTGCTGGTACTCAGCACATTTCAAATGATTTTA   29580
        Q  N  S  L  T  L  L  I  *  V  L  V  L  S  T  F  Q  M  I  L
         R  T  V  *  L  S  *  F  K  C  W  Y  S  A  H  F  K  *  F  Y
          E  Q  F  D  S  L  N  L  S  A  G  T  Q  H  I  S  N  D  F  T

29581   CTCCTGAGGATCATAGTTTACTTGCTACTCTTGATGATCCTTATGTAGAAGACTCTGTTG   29640
        L  L  R  I  I  V  Y  L  L  L  L  M  I  L  M  *  K  T  L  L
         S  *  G  S  *  F  T  C  Y  S  *  *  S  L  C  R  R  L  C  C
          P  E  D  H  S  L  L  A  T  L  D  D  P  Y  V  E  D  S  V  A

29641   CTTAATGAGAATGAATCCTAATTCGACACTAGGTGGTAACCCCTCGCTATTATTCGGAAT   29700
        L  N  E  N  E  S  *  F  D  T  R  W  *  P  L  A  I  I  R  N
         L  M  R  M  N  P  N  S  T  L  G  G  N  P  S  L  L  F  G  I
          *  *  E  *  I  L  I  R  H  *  V  V  T  P  R  Y  Y  S  E  *
```

FIG. 2 CONT.

```
29701   AGGACACTCTCTATCAGAATGAATTCTTGCTGTAATAACAGATAGAGTAGGTTGTTACAG   29760
        R  T  L  S  I  R  M  N  S  C  C  N  N  R  *  S  R  L  L  Q
         G  H  S  L  S  E  *  I  L  A  V  I  T  D  R  V  G  C  Y  R
          D  T  L  Y  Q  N  E  F  L  L  *  *  Q  I  E  *  V  V  T  D

29761   ACTATATATTAATTAGTAGAAATTTTATATTTAGACATTTGATTGTTAGAGTAGTTATAA   29820
        T  I  Y  *  L  V  E  I  L  Y  L  D  I  *  L  L  E  *  L  *
         L  Y  I  N  *  *  K  F  Y  I  *  T  F  D  C  *  S  S  Y  K
          Y  I  L  I  S  R  N  F  I  F  R  H  L  I  V  R  V  V  I  R

29821   GGTTTAGCTGTAGTATAAACGCCTCCGGGAAGAGCTATCAATTGTAGTGTTTAATATATA   29880
        G  L  A  V  V  *  T  P  P  G  R  A  I  N  C  S  V  *  Y  I
         V  *  L  *  Y  K  R  L  R  E  E  L  S  I  V  V  F  N  I  Y
          F  S  C  S  I  N  A  S  G  K  S  Y  Q  L  *  C  L  I  Y  I

29881   TATTAGTATATGATTGAAATTAATTATAGCCTTTTGGAGGAATTACAAAAAAAAAAAAAA   29940
        Y  *  Y  M  I  E  I  N  Y  S  L  L  E  E  L  Q  K  K  K  K
         I  S  I  *  L  K  L  I  I  A  F  W  R  N  Y  K  K  K  K  K
          L  V  Y  D  *  N  *  L  *  P  F  G  G  I  T  K  K  K  K  K

29941   AA                                                             29942
```

FIG. 2 CONT.

```
1   CTTATTCTCGCTTAACGCAGGCATGGCAGATAGTCGAATGCTAGAGAACAGTCTAGAGTA  60
      Y  S  R  I  A  D  T  G  D  I  L  K  R  D  R  T  L  D  *
     I  L  A  F  Q  T  R  V  T  *  *  S  V  I  E  Q  *  I  E
    F  L  L  S  N  R  G  Y  R  R  D  A  *  S  R  K  D  S  R  M

61  ATTTAGATTTGAAAAATTTGTTCTAAGGGACAATAGGTACGAACACTCACACCAAATTAG  120
     *  I  *  V  K  *  V  L  N  G  T  I  W  A  Q  S  H  P  K  I
    N  F  R  F  K  K  F  L  I  G  Q  *  G  H  K  H  T  H  N  L
     L  D  L  S  K  L  C  S  E  R  N  D  M  S  T  L  T  T  *  D

121 TATTAGAACATAAAATGAAAGGTGTGAAAAGTAGAGAGACGGTCACTGCACAACCAACAG  180
     M  I  K  Y  K  V  K  W  V  K  *  R  E  A  L  S  T  N  T  T
    *  L  R  T  N  *  K  G  C  K  E  D  R  Q  W  H  R  T  P  Q
     Y  D  Q  I  K  S  E  V  S  K  M  E  R  G  T  V  H  Q  N  D

181 GAGTCGCAGGGAGGGTATCCAGCGTTACTAATTTTGGTCGTTTATGCCAGAGCCGAAGTT  240
     R  L  T  G  G  M  P  R  L  S  *  F  W  C  I  R  D  R  S  *
    G  *  R  G  E  W  L  D  C  H  N  F  G  A  F  V  T  E  A  E
     E  A  D  R  G  Y  T  A  I  I  L  V  L  L  Y  P  R  P  K  L

241 CACCCGCGGTCTTAAAGCAACCGACGAAGGCCTACGTCGCCTCCTCAACCGATCAGGATA  300
     T  P  A  L  I  E  N  A  A  E  P  H  L  P  P  T  P  *  D  *
    L  P  R  W  F  K  T  P  Q  K  R  I  C  R  L  L  Q  S  T  R
     H  A  G  S  N  R  Q  S  S  G  S  A  A  S  S  N  A  L  G  I

301 CTTCAGTCTACTCCCACCCAATACGGGGAGATGACCAGTTCGCTACCTTTCACAACCTAA  360
     S  T  L  H  P  H  T  I  G  R  *  Q  D  L  S  P  F  H  Q  I
    H  L  *  I  L  T  P  *  A  G  R  S  T  L  R  H  F  T  N  S
     F  D  S  S  P  P  N  H  G  E  V  P  *  A  I  S  L  T  P  N

361 GCAAATACTATTAGTACACTTCTATCTAACAGCGACGTAAGAACCTGTTCTTACCGTACA  420
     R  K  H  Y  D  H  S  S  L  N  D  S  C  E  Q  V  L  I  A  H
    E  N  I  I  I  M  H  L  Y  I  T  A  A  N  K  S  L  F  P  M
     T  *  S  L  *  T  F  I  S  Q  R  Q  M  R  P  C  S  H  C  T

421 CGTCAGTTTAGAATAGGCACTATAAAAACAAGTACTTCTAGATGTACAACATCTTCAAGA  480
     A  T  L  D  *  G  H  Y  K  Q  E  H  L  D  V  H  Q  L  L  E
    H  L  *  I  K  D  T  I  N  K  N  M  F  I  *  M  N  Y  F  N
     C  D  F  R  I  R  S  I  K  T  *  S  S  R  C  T  T  S  T  R

481 TTGATTTTGTCGGCATTTCAGGCCATGCCGTTAAAATTAATTTAGTGGAAACGTATCGAA  540
     L  *  F  L  R  L  T  R  Y  P  L  K  L  *  I  V  K  A  Y  S
    *  S  F  C  G  Y  L  G  T  R  C  N  *  N  F  *  R  Q  M  A
     V  L  V  A  T  F  D  P  V  A  I  K  I  L  D  G  K  C  L  K
```

FIG. 3

```
541   CCCACCAAAAGGATTTCCCATACAATACCCGAACAAGGCAAGTATGTTCTGATTTGCAAT   600
       P  H  N  E  *  L  T  H  *  P  S  T  G  N  M  C  S  *  V  N
      Q  T  T  K  R  F  P  I  N  H  A  Q  E  T  *  V  L  S  F  T
        P  P  K  G  L  P  Y  T  I  P  K  N  R  E  Y  L  V  L  R  *

601   ACAACATGTAGTAGAAAGATACTGATGTAGATGATGATTAAAACCACTTCTAAAAAACCC   660
       H  Q  V  D  D  K  *  S  *  M  *  *  *  N  Q  H  L  N  K  P
      I  N  Y  M  M  K  R  H  S  C  R  S  S  I  K  T  F  I  K  Q
        T  T  C  *  R  E  I  V  V  D  V  V  L  K  P  S  S  K  K  P

661   AACCTAACATGGAAAACCAAAATACGGTAGAATACAAGTGTTTACCAAAGTTAAGACATC   720
       N  S  Q  V  K  Q  N  *  A  M  K  H  E  C  I  T  E  I  R  Y
      T  P  N  Y  R  K  T  K  H  W  R  I  N  V  F  P  K  L  E  T
        Q  I  T  G  K  P  K  I  G  D  *  T  *  L  H  N  *  N  Q  L

721   CAACATATAACTTCTCTCACTAAATTATTAAAGTTTAAAATTTAAACTACTAATACTAAA   780
       T  T  Y  Q  L  S  H  N  L  L  K  L  N  *  I  Q  H  N  H  N
      P  Q  I  N  F  L  T  I  *  Y  N  *  I  K  F  K  I  I  I  I
        N  Y  I  S  S  L  S  K  I  I  E  F  K  L  N  S  S  *  S  K

781   ATCACATCTTCTACGAATACGACTCCAAGTACGACTCGGATTTCCATTTATAAGTGTTTT   840
       *  H  L  L  H  K  H  Q  P  E  H  Q  A  *  L  Y  I  N  V  F
      K  T  Y  F  I  S  I  S  L  N  M  S  L  R  F  T  F  I  *  L
        L  T  S  S  A  *  A  S  T  *  A  S  G  L  P  L  Y  E  C  F

841   TCGAATACGAAATGAATCTGTTATAGCACCATAATTTGGGCATGAAAAACATCTGGTCAT   900
       L  K  H  K  V  *  V  I  D  H  Y  *  V  R  V  K  Q  L  G  T
      F  S  I  S  *  K  S  L  I  T  T  N  F  G  Y  K  K  Y  V  L
        A  *  A  K  S  L  C  Y  R  P  I  L  G  T  S  K  T  S  W  Y

901   ACCAACACTGATAAGACCATTTAATCGTCTAACAGAAGTTCGAATACCAGTAATAAGAAA   960
       H  N  H  S  N  Q  Y  I  L  L  N  D  E  L  K  H  D  N  N  K
      I  T  T  V  I  R  T  F  *  C  I  T  K  L  S  I  T  M  I  R
        P  Q  S  *  E  P  L  N  A  S  Q  R  *  A  *  P  *  *  E  K

961   CGTTCTATACTCTGTTTTCGTCAGACATACCGAACGGTTAACACTGAAACTATAACATCA   1020
       A  L  Y  S  V  F  A  T  Q  I  A  Q  W  N  H  S  Q  Y  Q  L
      Q  L  I  H  S  L  L  L  R  Y  P  K  G  I  T  V  K  I  N  Y
        C  S  I  L  C  F  C  D  T  H  S  A  L  Q  S  K  S  I  T  T

1021  CCGAACCGTACATCAAGCACTAAGTGCTAAACAATACGCGGACGTCTGATATCGATGATA   1080
       P  K  A  H  L  E  H  N  V  I  Q  *  A  G  A  S  *  L  *  *
      H  S  P  M  Y  N  T  I  *  S  K  N  H  A  Q  L  S  Y  S  S
        A  Q  C  T  T  R  S  E  R  N  T  I  R  R  C  V  I  A  V  I
```

FIG. 3 CONT'D

```
1081 AACACCATAATTTATACAACGTGTTGGATGTCTTCTACATCATCTACCTCTACATCAATA 1140
      K  H  Y  *  I  H  Q  V  V  *  L  L  H  L  L  H  L  H  L  *
     N  T  T  N  F  I  N  C  L  R  C  F  I  Y  Y  I  S  I  Y  N
       Q  P  I  L  Y  T  A  C  G  V  S  S  T  T  S  P  S  T  T  I

1141 TGCACTTGGACATGTAAATAATAGACGACTACGTTATCAAAATTTCGAAGGATCAAACTA 1200
      V  H  V  Q  V  N  I  I  Q  Q  H  L  L  K  L  A  E  *  N  S
     Y  T  F  R  Y  M  *  *  R  S  I  C  Y  N  *  L  K  R  T  Q
       R  S  G  T  C  K  N  D  A  S  A  I  T  K  F  S  G  L  K  I

1201 CTTTCAATACTGAGTATACCTACTAAAAAGATAATTTAGATATATATTACAACTAAACAC 1260
      S  L  *  S  E  Y  P  H  N  K  *  *  I  *  I  Y  H  Q  N  T
     H  F  N  H  S  M  H  I  I  K  R  N  F  R  Y  I  I  N  I  Q
       F  T  I  V  *  I  S  S  K  E  I  L  D  I  Y  L  T  S  K  H

1261 ACTAACACCAAAACAATACGTCATACCAATACATCTAACAAAATTACTATTAACACTAAA 1320
      H  N  H  N  Q  *  A  T  H  N  H  L  N  N  *  H  Y  N  H  N
     T  I  T  T  K  N  H  L  I  T  I  Y  I  T  K  I  I  I  T  I
       S  Q  P  K  T  I  C  Y  P  *  T  S  Q  K  L  S  L  Q  S  K

1321 AATACCAACCCAAAGTCCATTATACTACCTACCAAAAAGAACAGGTAACACAACATGTCA 1380
      K  H  N  P  K  L  Y  Y  S  P  H  N  K  K  D  M  T  N  Y  L
     K  I  T  P  N  *  T  I  H  H  I  T  K  R  T  W  Q  T  T  C
       *  P  Q  T  E  P  L  I  I  S  P  K  E  Q  G  N  H  Q  V  T

1381 AATACTGAGATCGCTTCAATTTCGGGTTAGTAGACCACAATAAGGACTTTTAGGACACAA 1440
      K  H  S  *  R  L  *  L  G  I  M  Q  H  *  E  Q  F  D  Q  T
     N  I  V  R  A  F  N  F  G  L  *  R  T  N  N  R  F  I  R  H
       *  S  E  L  S  T  L  A  W  D  D  P  T  I  G  S  F  G  T  N

1441 TAAATGATTATCATGACTATGACAATTGGTACTAAGAAAATTAAACATACCAATAAGACA 1500
      I  *  *  Y  Y  Q  Y  Q  *  G  H  N  K  *  N  T  H  N  N  Q
     *  K  S  I  T  S  I  S  N  V  M  I  R  K  I  Q  I  T  I  R
       N  V  L  L  V  S  V  T  L  W  S  E  K  L  K  Y  P  *  E  T

1501 GTGTGGTAAACCAAGAACATATATAACCAGCGGCGCAGGACCTAACACCTAAGGATATTA 1560
      *  V  M  Q  N  K  Y  I  N  T  A  A  D  Q  I  T  S  E  *  L
     D  C  W  K  T  R  T  Y  I  P  R  R  T  R  S  Q  P  N  R  Y
       V  G  N  P  E  Q  I  Y  Q  D  G  R  G  P  N  H  I  G  I  I

1561 ATTTAGAAGTCAGTTCAGAATACTACTAAACCAAATAAGTCCACATCATCCAACATTTAG 1620
      *  I  K  L  *  T  K  H  H  N  P  K  N  L  H  L  L  N  Y  I
     N  F  R  *  D  L  R  I  I  I  Q  N  I  *  T  Y  Y  T  T  F
       L  D  E  T  L  D  *  S  S  K  T  *  E  P  T  T  P  Q  L  D
```

FIG. 3 CONT'D

```
1621  ATAACAATTTCTTTGACGAGAATAATGAGTACGTGAAATGAATCTAATACAAGTTACATT  1680
         *  Q  *  L  F  Q  E  *  *  E  H  V  K  S  L  N  H  E  I  Y
        R  N  N  F  F  S  S  K  N  S  M  C  K  V  *  I  I  N  L  T
          I  T  L  S  V  A  R  I  V  *  A  S  *  K  S  *  T  *  H  L

1681  CACACCATTAGAACTTGTTTTAGTATAAGAACCGCAATTATTAAGAACCACATCCGTTGA  1740
         T  H  Y  D  Q  V  F  D  Y  E  Q  R  *  Y  N  K  T  Y  A  V
        L  T  T  I  K  F  L  I  M  N  K  A  N  I  I  R  P  T  P  L
          H  P  L  R  S  C  F  *  I  R  P  T  L  L  E  Q  H  L  C  S

1741  CAACGAATTATCTCCACTAATATTATACGAAGATTTTTTATAACTGAACAAACAATTCGC  1800
         T  A  *  Y  L  H  N  Y  Y  A  E  L  F  Y  Q  S  T  Q  *  A
        Q  Q  K  I  S  T  I  I  I  H  K  *  F  I  N  V  Q  K  N  L
          N  S  L  L  P  S  *  L  I  S  R  F  F  I  S  K  N  T  L  R

1801  AGCACGACTAAAACGAACGTTCAAACGTCAAACACCTCTACCAAAACATGGAAAAAATGA  1860
         D  H  Q  N  Q  K  C  T  Q  L  K  H  L  H  N  Q  V  K  K  V
        T  T  S  I  K  S  A  L  K  C  N  T  S  I  T  K  Y  R  K  *
          R  A  S  K  A  Q  L  N  A  T  Q  P  S  P  K  T  G  K  K  S

1861  TCTACCAAATTAAGGGGCATCAATAATAGATTAAGTCTCACCATAAAAGAAATGTAGAAA  1920
         L  H  N  L  E  G  Y  N  N  D  L  E  S  H  Y  K  R  *  M  K
        *  I  T  *  N  G  T  T  I  I  *  N  L  T  T  N  E  K  C  R
          S  P  K  I  G  R  L  *  *  R  I  *  L  P  I  K  K  V  D  K

1921  CTACAGAGTTAAAAGTGTTCTTCAAAGACTATACACAAATTTTTACACATAAAACAAATA  1980
         S  T  E  I  K  V  L  L  K  Q  Y  T  N  L  F  T  Y  K  T  *
        Q  H  R  L  K  *  L  F  N  R  I  H  T  *  F  H  T  N  Q  K
          I  D  *  N  E  C  S  T  E  S  I  H  K  F  I  H  I  K  N  I

1981  CCTGTCTCAAAGTCAACGATGTAAAATATATCTCGTAATACAATTATCCAACCAATGAGT  2040
         P  C  L  K  L  Q  *  M  K  Y  L  A  N  H  *  Y  T  P  *  E
        H  V  S  N  *  N  S  C  K  I  Y  L  M  I  N  I  P  Q  N  S
          S  L  T  E  T  A  V  N  *  I  S  C  *  T  L  L  N  T  V  *

2041  TAAATTCAATAACCCATGATGTGAACAATTATTTTACCAATTAACCAAATTATGGTACAA  2100
         I  *  T  I  P  Y  *  V  Q  *  Y  F  P  *  N  T  *  Y  W  T
        L  K  L  *  Q  T  S  C  K  N  I  F  H  N  I  P  K  I  G  H
          N  L  N  N  P  V  V  S  T  L  L  I  T  L  Q  N  L  V  M  N

2101  TCTACGATCACGTGGACGATGTCCGACCGAAGAAATGGTTAATAACTTACCAGAAAAACA  2160
         L  H  *  H  V  Q  *  L  S  A  E  K  G  I  I  S  H  D  K  Q
        *  I  S  T  C  R  S  C  A  P  K  K  V  L  *  Q  I  T  K  K
          S  A  L  A  G  A  V  P  Q  S  R  *  W  N  N  F  P  R  K  T
```

FIG. 3 CONT'D

```
2161 TCATAGAGTTCGGTTGAAATTAAAACAACGAAATTATGGACTAATACGATTTTAAAATCA 2220
      L  I  E  L  W  S  *  N  Q  Q  K  L  V  Q  N  H  *  F  K  L
     Y  Y  R  L  G  V  K  I  K  N  S  *  Y  R  I  I  S  F  N  *
       T  D  *  A  L  K  L  K  T  A  K  I  G  S  *  A  L  I  K  T

2221 ATTATTTAAAATGTGAAAAAAATTCAATAATAATCTCACACAATGTCAACTACAAAATTT 2280
      *  Y  I  K  C  K  K  *  T  I  I  L  T  H  *  L  Q  H  K  L
     N  I  F  K  V  S  K  K  L  *  *  *  L  T  N  C  N  I  N  *
       L  L  N  *  V  K  K  L  N  N  N  S  H  T  V  T  S  T  K  F

2281 TCTATACGGACAAGAATTTTGATAATTACCAAATCAAACATAACATCCGTTATTCAAAAT 2340
      L  Y  A  Q  E  *  F  *  *  H  N  L  K  Y  Q  L  C  Y  T  K
     F  I  H  R  N  K  F  S  N  I  T  *  N  T  N  Y  A  I  L  K
       S  I  G  T  R  L  V  I  L  P  K  T  Q  I  T  P  L  L  N  *

2341 ATTGCAATCATGTCCCAATTAAGGACCAAAACAAAATGGTACATTACGTGTCCTTGTTGT 2400
      Y  R  *  Y  L  T  L  E  Q  N  Q  K  V  M  Y  H  V  P  V  V
     I  V  N  T  C  P  *  N  R  T  K  N  *  W  T  I  C  L  F  L
       L  T  L  V  P  N  I  G  P  K  T  K  G  H  L  A  C  S  C  C

2401 TTAAATAAAAAAACTTCCGCAACGTCTTAGACAATATCATCTTCTACTACAATAACTCTT 2460
      F  K  N  K  Q  L  R  Q  L  I  Q  *  L  L  L  H  H  *  Q  S
     L  N  I  K  K  F  A  N  C  F  R  N  Y  Y  F  I  I  N  N  L
       I  *  K  K  S  P  T  A  S  D  T  I  T  S  S  S  T  I  S  F

2461 ACAGTTTAGAAGAAATAGTAGAATACTCATAACAGTTGGTGGATTTAGACATCTTTTTTA 2520
      H  *  I  K  K  I  M  K  H  T  N  D  V  V  *  I  Q  L  F  F
     I  D  F  R  R  *  *  R  I  L  I  T  L  W  R  F  R  Y  F  F
       T  L  D  E  K  D  D  *  S  Y  Q  *  G  G  L  D  T  S  F  I

2521 AACATAATATCTATTATACATGTACCCATTCACACCACTATTTAAAAAGGGATAACAGTA 2580
      K  Y  *  L  Y  Y  T  C  P  Y  T  H  H  Y  I  K  G  *  Q  *
     N  T  N  Y  I  I  H  V  H  T  L  T  T  I  F  K  E  R  N  D
       Q  I  I  S  L  I  Y  M  P  L  H  P  S  L  N  K  G  I  T  M

2581 CTTACTATTTTTATAAACAGAAAATCTAGTCCGAACCGCAAAAGGTACACGTCCATCTTT 2640
      S  H  Y  F  Y  K  D  K  L  D  P  K  A  N  E  M  H  L  Y  F
     H  I  I  F  I  N  T  K  *  I  L  S  P  T  K  W  T  C  T  S
       F  S  L  F  I  Q  R  K  S  *  A  Q  R  K  G  H  A  P  L  F

2641 TCAATTAAAATTGCTCTTTGGACAACAATACCTCTAAGGCAGAAACTACTGTCAATTCCA 2700
      L  *  N  *  R  S  V  Q  Q  *  P  S  E  T  K  S  S  L  *  P
     F  N  I  K  V  L  F  R  N  N  H  L  N  R  R  Q  H  C  N  L
       T  L  K  L  S  F  G  T  T  I  S  I  G  D  K  I  V  T  L  T
```

FIG. 3 CONT'D

```
2701 ATACAAACTAAATCTAAGATGAAAACTACTATAAAATCCATTTCAAACAAGTCTTAAACT 2760
      *  T  Q  N  L  N  *  K  Q  H  Y  K  L  Y  L  K  N  L  I  Q
     N  H  K  I  *  I  R  S  K  I  I  N  *  T  F  N  T  *  F  K
       I  N  S  K  S  E  V  K  S  S  I  K  P  L  T  Q  E  S  N  S

2761 TCATCTTTTCCCACAATGACATCTACTAAAACAACGACAACAAACACTACGATATCTCTT 2820
      L  L  F  P  H  *  Q  L  H  N  Q  Q  Q  Q  K  H  H  *  L  S
     F  Y  F  L  T  N  S  Y  I  I  K  N  S  N  N  T  I  S  Y  L
       T  S  F  P  T  V  T  S  S  K  T  A  T  T  Q  S  A  I  S  F

2821 ACGAAATTTGAGAACATTTCTCGTAGGTCACCAACCAATAGTTCAAGCACGTAAAAATTT 2880
      H  K  L  S  K  Y  L  A  D  L  P  Q  N  D  L  E  H  M  K  L
     I  S  *  V  R  T  F  L  M  W  H  N  T  I  L  N  T  C  K  *
       A  K  F  E  Q  L  S  C  G  T  T  P  *  *  T  R  A  N  K  F

2881 ATTTGAATTACTCTTACAACAAATAAATAAACTACTCCGACCACTACTTCGTTACCGGAG 2940
      Y  V  *  H  S  H  Q  K  N  I  Q  H  P  Q  H  H  L  L  P  R
     I  F  K  I  L  I  N  N  I  *  K  I  L  S  T  I  F  C  H  G
       L  S  L  S  F  T  T  *  K  N  S  S  A  P  S  S  A  I  A  E

2941 AGCATACATAACATGAAAACGATAACTCCTACAACTTCTGCAATAGTCATCACTTCGACA 3000
      E  Y  T  N  Y  K  Q  *  Q  P  H  Q  L  R  *  *  Y  H  L  Q
     R  T  H  I  T  S  K  S  N  L  I  N  F  V  N  D  T  T  F  S
       R  I  Y  Q  V  K  A  I  S  S  T  S  S  T  I  L  L  S  A  T

3001 GCTTCTATGATAACTACCACAGCAACTTCTGTGATAATTACTGCTACTTCTACAACAATG 3060
      R  L  Y  *  Q  H  H  R  Q  L  C  *  *  H  R  H  L  H  Q  *
     D  F  I  S  N  I  T  D  N  F  V  S  N  I  V  I  F  I  N  N
       S  S  V  I  S  P  T  T  S  S  V  I  L  S  S  S  S  T  T  V

3061 ACCACTGTTACTGCTACTTCTACAACAATGACCACTGTTACTGCTACTTCTACAACAATG 3120
      Q  H  C  H  R  H  L  H  Q  *  Q  H  C  H  R  H  L  H  Q  *
     S  T  V  I  V  I  F  I  N  N  S  T  V  I  V  I  F  I  N  N
       P  S  L  S  S  S  S  T  T  V  P  S  L  S  S  S  S  T  T  V

3121 ACCACTGTTACTGCTACTTCTACAACAATGACCACTGTTACTGCTACTTCTACAACAATG 3180
      Q  H  C  H  R  H  L  H  Q  *  Q  H  C  H  R  H  L  H  Q  *
     S  T  V  I  V  I  F  I  N  N  S  T  V  I  V  I  F  I  N  N
       P  S  L  S  S  S  S  T  T  V  P  S  L  S  S  S  S  T  T  V

3181 ACCACTGTTACTGCTACTTCTACAACAATGACCACTGTTACTGCTACTTCTACAACAATG 3240
      Q  H  C  H  R  H  L  H  Q  *  Q  H  C  H  R  H  L  H  Q  *
     S  T  V  I  V  I  F  I  N  N  S  T  V  I  V  I  F  I  N  N
       P  S  L  S  S  S  S  T  T  V  P  S  L  S  S  S  S  T  T  V
```

FIG. 3 CONT'D

```
3241  ACCACTGTTACTGCTACTTCTACAACAATGACCACTGTTACTGCTACTTCTACAACAATG  3300
       Q  H  C  H  R  H  L  H  Q  *  Q  H  C  H  R  H  L  H  Q  *
      S  T  V  I  V  I  F  I  N  N  S  T  V  I  V  I  F  I  N  N
        P  S  L  S  S  S  S  T  T  V  P  S  L  S  S  S  S  T  T  V

3301  ACCACTGTTACTGCTACTTCTACAACAATGACCACTGTTACTGCTACTTCTACAACAATG  3360
       Q  H  C  H  R  H  L  H  Q  *  Q  H  C  H  R  H  L  H  Q  *
      S  T  V  I  V  I  F  I  N  N  S  T  V  I  V  I  F  I  N  N
        P  S  L  S  S  S  S  T  T  V  P  S  L  S  S  S  S  T  T  V

3361  ACCACTGTTACTGCTACTTCTACAACAATGACCACTGTTACTGCTACTTCTACAACAATG  3420
       Q  H  C  H  R  H  L  H  Q  *  Q  H  C  H  R  H  L  H  Q  *
      S  T  V  I  V  I  F  I  N  N  S  T  V  I  V  I  F  I  N  N
        P  S  L  S  S  S  S  T  T  V  P  S  L  S  S  S  S  T  T  V

3421  ACCACTGTTACTGCTACTTCTACAACAATGACCACTGTTATTGCTACTTCTCTAACAATG  3480
       Q  H  C  H  R  H  L  H  Q  *  Q  H  C  Y  R  H  L  S  Q  *
      S  T  V  I  V  I  F  I  N  N  S  T  V  I  V  I  F  L  N  N
        P  S  L  S  S  S  S  T  T  V  P  S  L  L  S  S  S  I  T  V

3481  ACCACTGTTACTACTGGTTTAACAACAATGACCACTACTACATCTACTATAACTTTCATA  3540
       Q  H  C  H  H  G  F  Q  Q  *  Q  H  H  H  L  H  Y  Q  F  Y
      S  T  V  I  I  V  L  N  N  N  S  T  I  I  Y  I  I  N  F  T
        P  S  L  S  S  W  I  T  T  V  P  S  S  T  S  S  I  S  L  I

3541  AATACTGAAACTATGAATATTTCGAGAAAATCAAAAATTACTACAGATATTACTACGAAA  3600
       K  H  S  Q  Y  K  Y  L  E  K  L  K  *  H  H  R  Y  H  H  K
      N  I  V  K  I  S  I  F  S  K  *  N  K  I  I  D  I  I  I  S
        *  S  K  S  V  *  L  A  R  K  T  K  L  S  T  *  L  S  A  K

3601  CAAACAATCAATACCAAGATCACAACTTTGTCTTTGTATAAAATTTCAATTACCAAATAC  3660
       T  Q  *  N  H  N  *  H  Q  F  L  F  M  N  *  L  *  H  N  I
      Q  K  N  T  I  T  R  T  N  F  C  F  C  I  K  F  N  I  T  *
        N  T  L  *  P  E  L  T  S  V  S  V  Y  K  L  T  L  P  K  H

3661  CAGTGGATGATAATGTGTATGATTAACAACCAACGCAAGACACAATGAACATTACGTCTT  3720
       T  V  *  *  *  V  Y  *  N  N  T  A  N  Q  T  V  Q  L  A  S
      P  *  R  S  N  C  M  S  I  T  P  Q  T  R  H  *  K  Y  H  L
        D  G  V  I  V  C  V  L  Q  Q  N  R  E  T  N  S  T  I  C  F

3721  TAATGGAAAATTCAAATTCCTAAATCGATAACTTTTATACACCAATAGAATATTCCACCC  3780
       I  V  K  *  T  *  P  N  L  *  Q  F  Y  T  T  I  K  Y  P  P
      F  *  R  K  L  K  L  I  *  S  N  F  I  H  P  *  R  I  L  H
        N  G  K  L  N  L  S  K  A  I  S  F  I  H  N  D  *  L  T  P
```

FIG. 3 CONT'D

```
3781 AATATTAGTTTCAAAACAACTAATAAATGACTGGTGATAAGGATTTCGATAACAAAACGG 3840
      N  Y  D  F  N  Q  Q  N  N  V  S  W  *  E  *  L  *  Q  K  A
     T  I  I  L  T  K  N  I  I  *  Q  G  S  N  R  F  S  N  N  Q
       *  L  *  L  K  T  S  *  K  S  V  V  I  G  L  A  I  T  K  G

3841 AGTTCCACCAAAACATCGACTAAAACGAATAACCAAAAATTTGGTCAAACTATAATTACG 3900
      E  L  H  N  Q  L  Q  N  Q  K  N  T  K  L  G  T  Q  Y  *  H
     R  L  T  T  K  Y  S  I  K  S  I  P  K  *  V  L  K  I  N  I
       *  P  P  K  T  A  S  K  A  *  Q  N  K  F  W  N  S  I  L  A

3901 CATACGATTAACCACAACAAATTTTACACCAAAAAGAAAACTAAATTTACCAAACCTACG 3960
      T  H  *  N  T  N  N  L  I  H  N  K  K  Q  N  L  H  N  P  H
     R  I  S  I  P  T  T  *  F  T  T  K  R  K  I  *  I  T  Q  I
       Y  A  L  Q  H  Q  K  F  H  P  K  E  K  S  K  F  P  K  S  A

3961 AAACAAAAAAATACCTCTATAACACAGAGTACAAACATTCACACCTGTATTATACTGAGA 4020
      K  T  K  K  H  L  Y  Q  T  E  H  K  Y  T  H  V  Y  Y  S  E
     S  Q  K  K  I  S  I  N  H  R  M  N  T  L  T  S  M  I  H  S
       K  N  K  *  P  S  I  T  D  *  T  Q  L  H  P  C  L  I  V  R

4021 TTATCGTCGCCTGAATGGAACATGTAATGTAAAAAGTAATAAACTACTGTTAAAAACACG 4080
      L  L  L  P  S  V  K  Y  M  V  N  K  M  I  Q  H  C  N  K  H
     *  Y  C  R  V  *  R  T  C  *  M  K  *  *  K  I  V  I  K  T
       I  A  A  S  K  G  Q  V  N  C  K  E  N  N  S  S  L  K  Q  A

4081 AAAAACGTGGGGATTTTTTTAAAAATAACGACGTACACGACACCTACATTTGCAAACAGT 4140
      K  K  C  G  *  F  F  K  *  Q  Q  M  H  Q  P  H  L  R  K  D
     S  K  A  G  R  F  F  N  K  N  S  C  T  S  H  I  Y  V  N  T
       K  Q  V  G  L  F  I  K  I  A  A  H  A  T  S  T  F  T  Q  *

4141 AAGACATCGACAATATCCACTACTTGTTTATCTACCATTCAAACAATGATTTAAATCACC 4200
      N  Q  L  Q  *  L  H  H  V  F  L  H  Y  T  Q  *  *  I  *  H
     M  R  Y  S  N  Y  T  I  F  L  Y  I  T  L  K  N  S  F  K  T
       E  T  A  T  I  P  S  S  C  I  S  P  L  N  T  V  L  N  L  P

4201 ACTATTTAAACTAAAATATCATCCAATACCTTACAGTAAATCATACAGAAGAAAACTCAA 4260
      H  Y  I  Q  N  *  L  L  N  H  F  T  M  *  Y  T  K  K  Q  T
     T  I  F  K  I  K  Y  Y  T  I  S  H  *  K  T  H  R  R  K  L
       S  L  N  S  K  I  T  P  *  P  I  D  N  L  I  D  E  K  S  N

4261 TGGAGTTAACATACCAAACACATATTGTGGATTACATACAAAACAATTTCCACTATAATA 4320
      V  E  I  T  H  N  T  Y  L  V  *  H  I  N  Q  *  L  H  Y  *
     *  R  L  Q  I  T  Q  T  Y  C  R  I  Y  T  K  N  F  T  I  N
       G  *  N  Y  P  K  H  I  V  G  L  T  H  K  T  L  P  S  I  I
```

FIG. 3 CONT'D

```
4321  TTTACAACGATCTGAACAATTTCGACTACAATAACAATTAGGACGATTACCCGTATACGA  4380
       L  H  Q  *  V  Q  *  L  Q  H  *  Q  *  D  Q  *  H  A  Y  A
      Y  I  N  S  S  K  N  F  S  I  N  N  N  I  R  S  I  P  M  H
        F  T  A  L  S  T  L  A  S  T  I  T  L  G  A  L  P  C  I  S

4381  GGTACCACCACCTCAACGTTTTCGATATCGACATCGACGTCCATTTTTTAAAAGATTTCT  4440
       G  H  H  H  L  Q  L  L  *  L  Q  L  Q  L  Y  F  I  K  *  L
      E  M  T  T  S  N  C  F  S  Y  S  Y  S  C  T  F  F  K  R  F
        W  P  P  P  T  A  F  A  I  A  T  A  A  P  L  F  N  E  L  S

4441  TTGACGACGATACCAATTTAGATTTCCACAAACGGTTCATCCTCTAACAATACAAAGATG  4500
       F  Q  Q  *  P  *  I  *  L  H  K  G  L  L  L  N  N  H  K  *
      F  S  S  S  H  N  F  R  F  T  N  A  L  Y  S  I  T  I  N  R
        V  A  A  I  T  L  D  L  P  T  Q  W  T  P  S  Q  *  T  E  V

4501  GCCACCATTTAATACATTTTGTTAAGAATTATAACATCCGGGACTACGATCTGTTCTACC  4560
       R  H  Y  I  I  Y  F  L  E  *  Y  Q  L  G  Q  H  *  V  L  H
      G  T  T  F  *  T  F  C  N  K  I  N  Y  A  R  I  S  S  L  I
        P  P  L  N  H  L  V  I  R  L  I  T  P  G  S  A  L  C  S  P

4561  TTCTGTTAGAATACAAAACAATCGTGCACGAATATTCGTAGAATTATTAATACTAACAAC  4620
       F  V  I  K  H  K  T  L  V  H  K  Y  A  D  *  Y  N  H  N  N
      S  S  L  R  I  N  Q  *  C  T  S  I  L  M  K  I  I  I  I  T
        L  C  D  *  T  K  N  A  R  A  *  L  C  R  L  L  *  S  Q  Q

4621  AAACAGATGAGAGTATAGCCGACCATATAAATCACAAGGACGACTACACAGTAATTGAAT  4680
       N  T  *  E  *  I  P  Q  Y  I  *  H  E  Q  Q  H  T  M  L  K
      T  Q  R  S  E  Y  R  S  T  Y  K  T  N  R  S  I  H  *  *  S
        K  D  V  R  M  D  A  P  I  N  L  T  G  A  S  T  D  N  V  *

4681  GGAAGATCCACAACAACTATTTGTTCAATAGGAACAATCATTATTATTTCTTCTAAAACT  4740
       G  E  L  H  Q  Q  Y  V  L  *  G  Q  *  Y  Y  Y  L  L  N  Q
      V  K  *  T  N  N  I  F  L  N  D  K  N  T  I  I  F  F  I  K
        R  R  P  T  T  S  L  C  T  I  R  T  L  L  L  L  S  S  K  S

4741  ATAATAAGTTTTTACAGTTTAATGAAGTCAACAACCATGATTTCGTAACCGACAATCTAA  4800
       Y  *  E  F  I  D  F  *  K  L  Q  Q  Y  *  L  M  P  Q  *  I
      I  N  N  L  F  T  L  N  S  *  N  N  T  S  F  C  Q  S  N  S
        I  I  *  F  H  *  I  V  E  T  T  P  V  L  A  N  A  T  L  N

4801  TTGACGATTACATCCGGCACAATAATTTAAACTCTGTCTACGTATGTTTGAAAAAAACTC  4860
       L  Q  *  H  L  G  H  *  *  I  Q  S  L  H  M  C  V  K  K  S
      *  S  S  I  Y  A  T  N  N  F  K  L  C  I  C  V  F  K  K  Q
        V  A  L  T  P  R  T  I  L  N  S  V  S  A  Y  L  S  K  K  L
```

FIG. 3 CONT'D

```
4861 ACCACTACTAACAAAACAAAGTTTAAGAAGACAATATGTTCTTCAAAATAACGAAGCAGT 4920
      H  H  H  N  N  Q  K  L  N  K  Q  *  V  L  L  K  I  A  E  D
     T  T  I  I  T  K  N  *  I  R  R  N  Y  L  F  N  *  Q  K  T
       P  S  S  Q  K  T  E  F  E  E  T  I  C  S  T  K  N  S  R  *

4921 ACTATATGTTAACTTATTACTGCAAGCACTAATAAACAACAGATTCTACTGATCAGAAGG 4980
      H  Y  V  I  S  Y  H  R  E  H  N  N  T  T  *  S  S  *  D  E
     M  I  Y  L  Q  I  I  V  N  T  I  I  Q  Q  R  L  H  S  T  K
       S  I  C  N  F  L  S  T  R  S  *  K  N  D  L  I  V  L  R  G

4981 ATTTCTAACCGCAGAATAGTTATTTAAACTACAATAATTGCCACAATTTTGACAATTCAT 5040
      *  L  N  A  D  *  *  Y  I  Q  H  *  *  R  H  *  F  Q  *  T
     R  F  I  P  T  K  D  I  F  K  I  N  N  V  T  N  F  S  N  L
       L  S  Q  R  R  I  L  L  N  S  T  I  L  P  T  L  V  T  L  Y

5041 AAAACTCACAGGATTAAGATAAATATATACATCAGTCCCATTTCTGAAACCAATACATAC 5100
      N  Q  T  D  *  N  *  K  Y  I  Y  D  P  Y  L  S  Q  N  H  I
     I  K  L  T  R  I  R  N  I  Y  T  T  L  T  F  V  K  T  I  Y
       K  S  H  G  L  E  I  *  I  H  L  *  P  L  S  K  P  *  T  H

5101 ACTACCAAGAAAAATATTTCGTTGACAATTAGTTCAAACACAAAATAATCGATTCTTCTA 5160
      H  H  N  K  K  Y  L  L  Q  *  D  L  K  H  K  I  L  *  S  S
     T  I  T  R  K  I  F  C  S  N  I  L  N  T  N  *  *  S  L  L
       S  P  E  K  *  L  A  V  T  L  *  T  Q  T  K  N  A  L  F  I

5161 TCTACAAAACGAATGACATCTACCACAATTAAAATTTAGATAAAGAGAATGACATCCACT 5220
      L  H  K  A  *  Q  L  H  H  *  N  *  I  *  K  E  *  Q  L  H
     Y  I  N  Q  K  S  Y  I  T  N  I  K  F  R  N  R  K  S  Y  T
       S  T  K  S  V  T  S  P  T  L  K  L  D  I  E  R  V  T  P  S

5221 TCAAAAACCATTTTATGAACCATTACAAAAGACACTACCGTAACTACAATGATTCAATTT 5280
      L  K  Q  Y  F  V  Q  Y  H  K  R  H  H  C  Q  H  *  *  T  L
     F  N  K  T  F  Y  K  T  I  N  E  T  I  A  N  I  N  S  L  *
       T  K  P  L  I  S  P  L  T  K  Q  S  P  M  S  T  V  L  N  F

5281 CACATCACTAAAAATACGGCTATTTTAAAATATAGTCATACTTTTAAACAGAAATCGACT 5340
      T  Y  H  N  K  H  R  Y  F  K  I  D  T  H  F  N  T  K  L  Q
     L  T  T  I  K  I  G  I  F  N  *  I  L  I  F  I  Q  R  *  S
       H  L  S  K  *  A  S  L  I  K  Y  *  Y  S  F  K  D  K  A  S

5341 ATAAAGACGACATGTTTCAAGTAAACCCAAACTAGTCGTTGTTAACGAACGAATAATATT 5400
      Y  K  Q  Q  V  F  N  M  Q  T  Q  D  A  V  I  A  Q  K  N  Y
     I  N  R  S  Y  L  T  *  K  P  K  I  L  L  L  Q  K  S  I  I
       I  E  A  T  C  L  E  N  P  N  S  *  C  C  N  S  A  *  *  L
```

FIG. 3 CONT'D

```
5401  AAAAAATTGTCATACATTTACCAGACATCAACAATTGCCAGGTAAAAAAAGAAAACTTGT  5460
       N  K  L  L  I  Y  I  T  Q  L  Q  *  R  D  M  K  K  K  Q  V
      I  K  *  C  Y  T  F  P  R  Y  N  N  V  T  W  K  K  R  K  F
        K  K  V  T  H  L  H  D  T  T  T  L  P  G  N  K  E  K  S  C

5461  CAGAGTATTATTAACAATACACTTACATCGAACAGAATACAACGTCGTATAATTAGAATT  5520
       T  E  Y  Y  N  N  H  S  H  L  K  D  *  T  A  A  Y  *  D  *
      L  R  M  I  I  T  I  H  I  Y  S  T  K  H  Q  L  M  N  I  K
        D  *  L  L  Q  *  T  F  T  A  Q  R  I  N  C  C  I  L  R  L

5521  TAAATTATTTACCGTCACCGTCCTTCGTACCATACTTAAAGCACGACCGTCTGGTGTATC  5580
       I  *  Y  I  A  T  A  P  L  M  T  H  I  E  H  Q  C  V  V  Y
      F  K  I  F  P  L  P  L  F  C  P  I  F  K  T  S  A  S  W  M
        N  L  L  H  C  H  C  S  A  H  Y  S  N  R  A  P  L  G  C  L

5581  CAATCAACGAGAACAAAATCGATTTCCAGTAAAATTTAAACTACTTGGTAGTCTACGATG  5640
       T  L  Q  E  Q  K  L  *  L  D  N  *  I  Q  H  V  M  L  H  *
      P  *  N  S  K  N  *  S  F  T  M  K  F  K  I  F  W  *  I  S
        N  T  A  R  T  K  A  L  P  *  K  L  N  S  S  G  D  S  A  V

5641  ACTAAAATAAGCACAACAAAACTTTGTTCGACTAAATAGTCCACGTTAAACACTTAATCT  5700
       Q  N  *  E  H  Q  K  S  V  L  Q  N  I  L  H  L  K  H  I  L
      S  I  K  N  T  N  N  Q  F  L  S  I  *  *  T  C  N  T  F  *
        S  K  I  R  T  T  K  F  C  A  S  K  D  P  A  I  Q  S  N  S

5701  TGAATAAACACTAACACCATAATTTGTTCTTTCAGCACAACCACAACTACGACAATACGT  5760
       V  *  K  H  N  H  Y  *  V  L  F  D  H  Q  H  Q  H  Q  *  A
      F  K  N  T  I  T  T  N  F  L  F  T  T  N  T  N  I  S  N  H
        S  I  Q  S  Q  P  I  L  C  S  L  R  T  P  T  S  A  T  I  C

5761  AAAACCATGTAATCGTTTCTGACTAGAAAAATTACCAATATTCTAACCGACATTAACACG  5820
       N  Q  Y  M  L  L  S  Q  D  K  *  H  N  Y  S  Q  S  Y  N  H
      M  K  T  C  *  C  L  S  I  K  K  I  T  I  L  N  A  T  I  T
        K  P  V  N  A  F  V  S  R  K  L  P  *  L  I  P  Q  L  Q  A

5821  TCCATCTTAACAGGTAACATGATTTAACTTACATGGTAAAAACTAAACAAGATTATGAGG  5880
       L  Y  F  Q  G  N  Y  *  I  S  H  V  M  K  S  K  N  *  Y  E
      C  T  S  N  D  M  T  S  F  Q  I  Y  W  K  Q  N  T  R  I  S
        P  L  I  T  W  Q  V  L  N  F  T  G  N  K  I  Q  E  L  V  G

5881  AGACTCATTCCTAAATGGACTACTACAACAACGTCGATTGTACAAATACCCACATCCACA  5940
       E  S  Y  P  N  V  Q  H  H  Q  Q  L  *  C  T  *  P  H  L  H
      R  Q  T  L  I  *  R  I  I  N  N  C  S  V  H  K  H  T  Y  T
        R  L  L  S  K  G  S  S  T  T  A  A  L  M  N  I  P  T  P  T
```

FIG. 3 CONT'D

5941 TCCGGTAATATGTGTAAACTTTACACCAAGTGGAATGGTTGTAATACTACGAACATCACA 6000
L G N Y V N S I H N V K G V N H H K Y H
Y A M I C M Q F T T * R V L M I I S T T
P W * V C K F H P E G * W C * S A Q L T

6001 ATTTTTTATATGTCCACAATCACCAACAAATTGACTGACGAACATAGAATTTTTAAATTG 6060
* F I Y L H * H N N L Q S S T D * F N L
N F F I C T N T T T * S V A Q I K F I *
L F Y V P T L P Q K V S Q K Y R L F K V

6061 GGTCTGAAAATGTAGATACAACTGATTAATAAAAAACCTACTACAACTTTACCAACGAAT 6120
G S K * M * T S * N N K P H H Q F P Q K
G L S K C R H Q S I I K Q I I N F H N S
W V K V D I N V L * K K S S T S I T A *

6121 ATTGGGACTAGAAAGTGTTATAATAACACTATTACCATTCATAATATGTTTTGGATAATA 6180
Y G Q D K V I N N H Y H Y T N Y L V * *
I V R I K * L I I T I I T L I I C F R N
L G S R E C Y * Q S L P L Y * V F G I I

6181 TTTCCGAGTCAAATTTGGTAAACGATTTCAACTGCCACAAATATGATTGAAATTCAATCA 6240
L P E T * V M Q * L Q R H K Y * S * T L
Y L S L K F W K S F N V T N I S V K L *
F A * N L G N A L T S P T * V L K L N T

6241 ACCTGTACTATAAACACGAGTTAACTTACTATTCAATCCAAAATTACATCTAAACGGCAA 6300
Q V H Y K H E I S H Y T L N * H L N A T
N S M I N T S L Q I I L * T K I Y I Q R
P C S I Q A * N F S L N P K L T S K G N

6301 ACAACTCATGTTTCATTGTCAGACCGGACATCGATGACCACTACAACAAAACCGTAGACT 6360
Q Q T C L L L R A Q L * Q H H Q K P M Q
K N L V F Y C D P R Y S S T I N N Q C R
T S Y L T V T Q G T A V P S T T K A D S

6361 ACTAAATATACACTTTGCAATAAAATTTCCTACACTTTGAAAACCATTCGGACAATAAAC 6420
H N I H S V N N * L I H F K Q Y A Q * K
I I * I H F T I K F S T F S K T L R N N
S K Y T F R * K L P H S V K P L G T I Q

6421 CAAAACAGTACTACTTCGTAGTAACTTAAGAGAATGAATAAAATTATTTGGATCAAAATT 6480
T K D H H L M M S N E * K N * Y V * N *
P K T M I F C * Q I R K S I K I F R T K
N Q * S S A D N F E R V * K L L G L K L

FIG. 3 CONT'D

```
6481 TAGACTTTTATCTATATCACAAAACAGACAACTAAGACATAGACTCCTCAGTGTTCCATT 6540
      I  Q  F  Y  I  Y  H  K  T  Q  Q  N  Q  I  Q  P  T  V  L  Y
     F  R  F  I  S  I  T  N  Q  R  N  I  R  Y  R  L  L  *  L  T
       D  S  F  L  Y  L  T  K  D  T  S  E  T  D  S  S  D  C  P  L

6541 ACACCAATGAAGACAATACCTTAGCGTCTAATCATGATTTCTCCAATTCAATTTCCCACA 6600
      H  P  *  K  Q  *  P  I  A  S  *  Y  *  L  P  *  T  L  P  H
     I  H  N  S  R  N  H  F  R  L  N  T  S  F  L  N  L  *  L  T
       T  T  V  E  T  I  S  D  C  I  L  V  L  S  T  L  N  F  P  T

6601 ATCTTTCTGACAATTTTATCTTCTACGATAATAACAATTACTACTTTTATCAAGATAATT 6660
      *  F  S  Q  *  F  L  L  H  *  *  Q  *  H  H  F  Y  N  *  *
     N  S  L  S  N  F  Y  F  I  S  N  N  N  I  I  F  I  T  R  N
       L  F  V  T  L  I  S  S  A  I  I  T  L  S  S  F  L  E  I  L

6661 CCAACAATTTTCAAATAGAAATCAACTACAAACCCTATACATAAACTGTCCAACACTAAT 6720
      P  Q  *  F  N  I  K  L  Q  H  K  P  Y  T  N  S  L  N  H  N
     L  N  N  F  T  *  R  *  N  I  N  P  I  H  I  Q  C  T  T  I
       T  T  L  L  K  D  K  T  S  T  Q  S  I  Y  K  V  P  Q  S  *

6721 ACAACAAACCCAACGATTACTTAACAGTGCGGATCAATTTAGTGGTTGTCAATCCCTTAT 6780
      H  Q  K  P  Q  *  H  I  T  V  G  L  *  I  V  L  L  *  P  I
     I  N  N  P  N  S  I  F  Q  *  A  *  N  F  *  W  C  N  P  F
       T  T  Q  T  A  L  S  N  D  R  R  T  L  D  G  V  T  L  S  Y

6781 ATATGCTATACCATAATTTGGATAATGATATGGATATCTAAACAATACAAATTCTCTACT 6840
      Y  V  I  H  Y  *  V  *  *  *  V  *  L  N  T  I  N  L  L  H
     I  Y  S  I  T  N  F  R  N  S  Y  R  Y  I  Q  *  T  *  S  I
       I  R  Y  P  I  L  G  I  V  I  G  I  S  K  N  H  K  L  S  S

6841 ATTAGTTTGAGAAAATCAAGGATTTTAAAAATTTCGTTCTCGATATCTTAAAATACCAAA 6900
      Y  D  F  E  K  L  E  *  F  K  *  L  L  L  *  L  I  K  H  N
     I  I  L  S  K  *  N  R  F  N  K  F  C  S  S  Y  F  K  I  T
       L  *  V  R  K  T  G  L  I  K  L  A  L  A  I  S  N  *  P  K

6901 AAACTTCACCAACAAATAAATACAAAAATCAAATAATGTAAAATGTTTACTATTTTGGTA 6960
      K  S  T  T  T  *  K  H  K  *  N  I  V  N  *  L  H  Y  F  W
     K  Q  L  P  Q  K  N  I  N  K  T  *  *  M  K  C  I  I  F  G
       K  F  H  N  N  I  *  T  K  L  K  N  C  K  V  F  S  L  V  M

6961 AAAAATATGATGTCTTTATCGAAGATTCAAATGAAAATTAAACAAAACAAACCGAGAATT 7020
      K  K  Y  *  L  F  L  K  *  T  *  K  *  N  T  K  N  P  E  *
     N  K  I  S  C  F  Y  S  R  L  K  S  K  I  Q  K  T  Q  S  K
       K  *  V  V  S  I  A  E  L  N  V  K  L  K  N  Q  K  A  R  L
```

FIG. 3 CONT'D

```
7021  TTTACGAAAAGTCTGTAAATCTACCTCATATAAATATTTTCCAAAAGAACAACATCGGTG  7080
       F  H  K  E  S  M  *  I  S  Y  I  *  L  L  N  E  Q  Q  L  W
      F  I  S  K  L  C  K  S  P  T  Y  K  Y  F  T  K  K  N  Y  G
        F  A  K  *  V  N  L  H  L  I  N  I  F  P  K  R  T  T  A  V

7081  ACACAAAAACAAAACCAAATTAAAAAACATATATTTACAATAAAAATCACTGAAAATAGA  7140
       Q  T  K  T  K  T  *  N  K  T  Y  L  H  *  K  *  H  S  K  D
      S  H  K  Q  K  P  K  I  K  Q  I  Y  I  N  N  K  T  V  K  I
        T  N  K  N  Q  N  L  K  K  Y  I  F  T  I  K  L  S  K  *  R

7141  AGGATTATAATCACAAAAAGGATAAAAACACCCTTCTTAACAATACACCTATTTCCGATG  7200
       E  *  Y  *  H  K  E  *  K  Q  P  F  F  Q  *  T  S  L  P  *
      K  R  I  N  T  N  K  R  N  K  H  S  S  N  N  H  P  Y  L  S
        G  L  I  L  T  K  G  I  K  T  P  L  I  T  I  H  I  F  A  V

7201  AAAACCAAACCAATGTTAAACACTAAAAATAAGATTCAATCCACATCCAAAATGTTCAGT  7260
       K  Q  N  P  *  L  K  H  N  K  N  *  T  L  H  L  N  *  L  D
      S  K  T  Q  N  C  N  T  I  K  I  R  L  *  T  Y  T  K  C  T
        K  P  K  T  V  I  Q  S  K  *  E  L  N  P  T  P  K  V  L  *

7261  AAAAACATTACCATCAAAATATACACTTAACACAGTAAGACCAAAACTATACAACCTATG  7320
       N  K  Y  H  Y  N  *  I  H  I  T  D  N  Q  N  Q  Y  T  P  Y
      M  K  T  I  T  T  K  Y  T  F  Q  T  M  R  T  K  I  H  Q  I
        K  Q  L  P  L  K  I  H  S  N  H  *  E  P  K  S  I  N  S  V

7321  TATACGTCGATATCTAAAACAAGTCATACTTCATCTATCTGCACAAAATAAACTAATACA  7380
       M  H  L  *  L  N  Q  E  T  H  L  L  Y  V  H  K  I  Q  N  H
      C  I  C  S  Y  I  K  N  L  I  F  Y  I  S  T  N  *  K  I  I
        Y  A  A  I  S  K  T  *  Y  S  T  S  L  R  T  K  N  S  *  T

7381  ATCAAATCAGTTTAATTAACAACTTGAGCAATAACCAATAAGTAATATGTGTCATACCAA  7440
       *  N  L  *  I  L  Q  Q  V  R  *  Q  N  N  M  I  C  L  I  T
      N  T  *  D  F  *  N  N  F  E  N  N  T  I  *  *  V  C  Y  P
        L  K  T  L  N  I  T  S  S  T  I  P  *  E  N  Y  V  T  H  N

7441  AATAGGTAATAAAACAGAATAACCAAATGTTAATAAATGATGTACCAACGGACTAAACAA  7500
       K  D  M  I  K  D  *  Q  N  V  I  I  *  *  M  T  A  Q  N  T
      K  I  W  *  K  T  K  N  T  *  L  *  K  S  C  P  Q  R  I  Q
        *  G  N  N  Q  R  I  P  K  C  N  N  V  V  H  N  G  S  K  N

7501  ATACAATCTTTGATACGTAACCAACTAATCTAAATAACATAAACATCGATTATACAATGG  7560
       *  T  L  F  *  A  N  T  S  *  I  *  Q  I  Q  L  *  Y  T  V
      K  H  *  F  S  H  M  P  Q  N  S  K  N  Y  K  Y  S  I  H  *
        I  N  S  V  I  C  Q  N  I  L  N  I  T  N  T  A  L  I  N  G
```

FIG. 3 CONT'D

```
7561  ACGAAAACAGAACAACGCCAAAATATATCAACAATGACGATACATATTTCATCAACCAAA  7620
       Q  K  Q  R  T  A  T  K  Y  L  Q  *  Q  *  T  Y  L  L  Q  N
      R  S  K  D  Q  Q  P  K  I  Y  N  N  S  S  H  I  F  Y  N  T
        A  K  T  K  N  R  N  *  I  T  T  V  A  I  Y  L  T  T  P  K

7621  ATAATCCGTATAACAGATACCAACATTATTTCGACCAACAAATAAAACAATATTTGCTTT  7680
       *  *  A  Y  Q  R  H  N  Y  Y  L  Q  N  N  I  K  N  Y  V  F
      K  N  P  M  N  D  I  T  T  I  F  S  T  T  *  K  T  I  F  S
        I  L  C  I  T  *  P  Q  L  L  A  P  Q  K  N  Q  *  L  R  F

7681  AACATCACAAGCACAATTCACATCATGATAACAACCACCACATTAAGCAATAATACTATA  7740
       N  Y  H  E  H  *  T  Y  Y  *  Q  Q  H  H  L  E  N  N  H  Y
      I  T  T  N  T  N  L  T  T  S  N  N  T  T  Y  N  T  I  I  I
        Q  L  T  R  T  L  H  L  V  I  T  P  P  T  I  R  *  *  S  I

7741  ATGACGATTACCACCATGACCAAAAACACAATTTGTAGTTACCTTAACAAAATTAACGGT  7800
       *  Q  *  H  H  Y  Q  N  K  H  *  V  D  I  S  N  N  *  N  G
      N  S  S  I  T  T  S  T  K  T  N  F  M  L  P  I  T  K  I  A
        V  A  L  P  P  V  P  K  Q  T  L  C  *  H  F  Q  K  L  Q  W

7801  AAGAAAATTTGGTCCATTGTGAAAATATTGACATCTTCGACGATATCTTGAAAGATTTCT  7860
       N  K  *  V  L  Y  C  K  *  L  Q  L  L  Q  *  L  V  K  *  L
      M  R  K  F  W  T  V  S  K  Y  S  Y  F  S  S  Y  F  K  R  F
        E  K  L  G  P  L  V  K  I  V  T  S  A  A  I  S  S  E  L  S

7861  CGAATTTGCTGGACATTTAGGTTGACTACGAAGTGTAATACATCAATGACTATAATTCGT  7920
       A  *  V  V  Q  L  D  L  Q  H  K  V  N  H  L  *  Q  Y  *  A
      L  K  F  S  R  Y  I  W  S  I  S  *  M  I  Y  N  S  I  N  L
        S  L  R  G  T  F  G  V  S  A  E  C  *  T  T  V  S  I  L  C

7921  TCAACCAACATACTACGCAAACAAGATACTATCTCTACCTGTCGCACAAATGCTACTACA  7980
       L  Q  N  Y  S  A  N  T  R  H  Y  L  H  V  A  H  K  R  H  H
      L  N  T  T  H  H  T  Q  E  I  I  S  I  S  L  T  N  V  I  I
        T  P  Q  I  I  R  K  N  *  S  L  S  P  C  R  T  *  S  S  T

7981  ACTACGATCAAATAAACATCTATAATTATTAGACAATGTAAGATTTCAATTTCAACAAGG  8040
       Q  H  *  N  I  Q  L  Y  *  Y  D  T  V  N  *  L  *  L  Q  E
      N  I  S  T  *  K  Y  I  N  I  I  Q  *  M  R  F  N  F  N  N
        S  A  L  K  N  T  S  I  L  L  R  N  C  E  L  T  L  T  T  G

8041  ATTAAACATACATCAACATCATCTCTCACTACGACTATCTCGATTAAAAGACTTACGACA  8100
       *  N  T  H  L  Q  L  L  S  H  H  Q  Y  L  *  N  E  S  H  Q
      R  I  Q  I  Y  N  Y  Y  L  T  I  S  I  S  S  I  K  Q  I  S
        L  K  Y  T  T  T  T  S  L  S  A  S  L  A  L  K  R  F  A  T
```

FIG. 3 CONT'D

8101 ACACAAAATACGTGTTAGTAACATATCCGGATATAATGAACATCTGTTTTTCAATTAATG 8160
Q T K H V I M T Y A * I V Q L C F T L *
N H K I C L * Q I P R Y * K Y V F L * N
T N * A C D N Y L G I N S T S L F N I V

8161 ATGTCGAACATTACCATAGAGACATTGGGTCTGATACAAACTACAAATACAACTATGAAA 8220
* L K Y H Y R Q L G S * T Q H K H Q Y K
S C S T I T D R Y G L S H K I N I N I S
V A Q L P I E T V W V I N S T * T S V K

8221 ATACAGAGTAAAACTACAACTATCTTTCTCAAAATTATTAAAACAATTGTAACGAGTACG 8280
* T E N Q H Q Y F S N * Y N Q * C Q E H
K H R M K I N I S L T K I I K N V N S M
I D * K S T S L F L K L L K T L M A * A

8281 AAGAGAATCTCTCCCACACGTTAATCTTTTCCAAAATCTATGAAAACACCCTACACATGC 8340
K E * L P H A I L F P K L Y K Q P I H V
S R K S L T H L * F L N * I S K H S T Y
E R L S P T C N S F T K S V K T P H T R

8341 ATTTACAACAAGGTAACTAAGTCTACAACTTTGTTCTAAATAATGATTTAGATACTATAG 8400
Y I N N W Q N L H Q F L I * * * I * S I
T F T T G N I * I N F C S K N S F R H Y
L H Q E M S E S T S V L N I V L D I I D

8401 ACGTCATCGACGACCAAACCTTAAATGACTACTTTTAATATTGTTAAACCATGGATGTAT 8460
Q L L Q Q N P I * Q H F N Y C N P V * M
R C Y S S T Q F K S I F I I V I Q Y R C
A T A A P K S N V S S F * L L K T G V Y

8461 AAATTTCTCACTATTATAACATCGACGACTAAATCCACAAGAATATGTCTTACCACGATT 8520
N L S H Y Y Q L Q Q N L H E * V S H H *
I * L T I I N Y S S I * T N K Y L I T S
K F L S L I T A A S K P T R I C F P A L

8521 CGTACATGTCCCATTACAACGATTCCGTCGATTATAAAGAACATATACCAAATAACTACG 8580
A H V P Y H Q * P L * Y K K Y I T * Q H
L M Y L T I N S L C S I N R T Y P K N I
C T C P L T A L A A L I E Q I H N I S A

8581 AAAATTAGTTGAATGACGACTAAATGTCGTATTTAATTTTTTTCGTACACAATTTTGACC 8640
K * D V * Q Q N V A Y I L F L M H * F Q
S K I L K S S I * L M F * F F C T N F S
K L * S V A S K C C L N F F A H T L V P

FIG. 3 CONT'D

8641 GAACTTCAATTTTAACTGAAAATTATTCGTTCTCCGTTCACAGGGATAAGAATGTTGTGG 8700
S S T L I S K * Y A L P L H G * E * L V
A Q L * F Q S K I L L L C T D R N K C C
K F N F N V K L L C S A L T G I R V V G

8701 GAAAAGTGAATTTCCTCCACAACATAACTCATTAAACAATATATATAATAAAAAACAATC 8760
R K V * L L H Q I S Y N T I Y I I K Q *
G K * K F S T N Y Q T I Q * I Y * K K N
K E S L P P T T N L L K N Y I N N K T L

8761 AAATTAGACAAAATATAATAACACCCGAAATAACGGATGTATATCACAAATATTCAGACT 8820
N L R N * I I T P K I A * M Y H K Y T Q
T * D T K Y * Q P S * Q R C I T N I L R
K I Q K I N N H A K N G V Y L T * L D S

8821 ATAAGTAAACGGACGAATACGATCAAAATTTCAATAACTATTACCACAACAATCTCTATA 8880
Y E N A Q K H * N * L * Q Y H H Q * L Y
I N M Q R S I S T K F N N I I T N N S I
I * K G A * A L K L T I S L P T T L S I

8881 AAGTCAATTACTAAATACAAAACGATTATTTAAAAAGGTTAAACTAGTTACCATACTCAG 8940
K L * H N I N Q * Y I K G I Q D I T H T
N * N I I * T K S I F K E L K I L P I L
E T L S K H K A L L N K W N S * H Y S D

8941 GTGAAAACCCAGACAAATGATAGTATTAAGATACCTAACGGGATAACATCACCGTCAATA 9000
W K Q T Q K S D Y N * P N G * Q L P L *
G S K P R N V I M I R H I A R N Y H C N
V K P D T * * * L E I S Q G I T T A T I

9001 CCTACTTCTATAGCCAAGATGATACAAATTACAAGGATGATTTCAAAACTCTGTACCGAA 9060
P H L Y R N * * T * H E * * L K S V H S
H I F I D T R S H K I N R S F N Q S M A
S S S I P E V I N L T G V L T K L C P K

9061 AGTACAAAATGTAAAAAATTGAATACGTAAACGATCACTATCACAAGTCACGATATGTGG 9120
E H K V N K L K H M Q * H Y H E T S Y V
K M N * M K * S I C K S T I T N L A I C
* T K C K K V * A N A L S L T * H * V G

9121 TGTATAAGTCTAAAGAATATTACTAAAAATACGATCACCAACACAAAATAGTAGAAACAC 9180
V Y E S K K Y H N K H * H N H K I M K T
W M N L N R I I I K I S T T T N * * R Q
C I * I E * L S K * A L P Q T K D D K H

FIG. 3 CONT'D

```
9181  ATGATACAAATTTTCTCCACTACCATGTGGTGTAGGAATAACAATAAGTCTACCACAATA  9240
       Y  *  T  *  F  L  H  H  Y  V  V  D  K  N  N  N  L  H  H  *
      T  S  H  K  F  S  T  I  T  C  W  M  R  I  T  I  *  I  T  N
        V  I  N  L  L  P  S  P  V  G  C  G  *  Q  *  E  S  P  T  I

9241  CTTCTTACGAAGAAACATATGTAGAAACCAAGGTGTATGTGCAATATCGGAACGATTAAG  9300
       S  S  H  K  K  T  Y  M  K  P  E  V  Y  V  N  Y  G  Q  *  N
      H  L  I  S  R  Q  I  C  R  Q  N  W  M  C  T  I  A  K  S  I
        F  F  A  E  K  Y  V  D  K  T  G  C  V  R  *  L  R  A  L  E

9301  ATTACCAAAATATTCTAAAGGACTACAATAATCACTTCCATAACATGCATAACATTCTTG  9360
       *  H  N  *  L  I  E  Q  H  *  *  H  L  Y  Q  V  Y  Q  L  F
      R  I  T  K  Y  S  K  R  I  N  N  T  F  T  N  Y  T  N  Y  S
        L  P  K  I  L  N  G  S  T  I  L  S  P  I  T  R  I  T  L  V

9361  CGCGAGATACTGAATAACATCTCACCCACGTACACTTATGCGGCTTCTCCCATATACAAA  9420
       A  S  *  S  K  N  Y  L  P  H  M  H  I  R  R  L  P  Y  I  N
      R  A  R  H  S  I  T  S  H  T  C  T  F  V  G  F  L  T  Y  T
        R  E  I  V  *  Q  L  T  P  A  H  S  Y  A  S  S  P  I  H  K

9421  ATTAAAATTATCAAGGACCCAAAACTTATTACTAATAATATCTTCATACGGACCTTGAAA  9480
       *  N  *  Y  N  R  P  K  S  Y  H  N  N  Y  F  Y  A  Q  F  K
      K  I  K  I  T  G  P  N  Q  I  I  I  I  I  S  T  H  R  S  S
        L  K  L  L  E  Q  T  K  F  L  S  *  *  L  L  I  G  P  V  K

9481  AACACCATCTCTAGAAAAACTAAACAAAATAGTTAAAAAATCATCAAATTAAGCAGGATA  9540
       K  H  Y  L  D  K  Q  N  T  K  D  I  K  *  Y  N  L  E  D  *
      K  T  T  S  I  K  K  I  Q  K  I  L  K  K  T  T  *  N  T  R
        Q  P  L  S  R  K  S  K  N  *  *  N  K  L  L  K  I  R  G  I

9541  TCTAAAGAAAAGAGAATGACGATCAAGATAAAAACCTCGATATAACCGATATCAACAACA  9600
       L  N  R  K  E  *  Q  *  N  *  K  Q  L  *  I  P  *  L  Q  Q
      Y  I  E  K  R  K  S  S  T  R  N  K  S  S  Y  Q  S  Y  N  N
        S  K  K  E  R  V  A  L  E  I  K  P  A  I  N  A  I  T  T  T

9601  GAACCAAAAAAATAATAAATTATTTTGAATTCGCACGAAAACCTCTAATATGATCACAACA  9660
       R  P  K  K  N  N  L  L  V  *  A  H  K  Q  L  N  Y  *  H  Q
      D  Q  N  K  I  I  *  Y  F  K  L  T  S  K  S  I  I  S  T  N
        K  T  K  *  *  K  I  F  S  L  R  A  K  P  S  *  V  L  T  T

9661  TCAATATTTACAACAACAAACCACATAATTAAAAGAATACGAAAAACAAAAAGTTCAAAT  9720
       L  *  L  H  Q  Q  K  T  Y  *  N  E  *  A  K  Q  K  E  L  K
      Y  N  Y  I  N  N  N  P  T  N  I  K  K  H  K  K  N  K  L  N
        T  I  F  T  T  T  Q  H  I  L  K  R  I  S  K  T  K  *  T  *
```

FIG. 3 CONT'D

```
9721   AGGATAAACACGTACACAAATACGAACAAAAATAAAAATACATTGTAACATAAAAGGAAG   9780
        D  *  K  H  M  H  K  H  K  N  K  N  K  H  L  M  T  N  E  K
       I  R  N  T  C  T  N  I  S  T  K  I  K  I  Y  C  Q  I  K  R
         G  I  Q  A  H  T  *  A  Q  K  *  K  *  T  V  N  Y  K  G  E

9781   ACTTTAATCACATTAATACGTAAACGTTACCTAACAATACATACCACGATATTACGGAAA   9840
        Q  F  *  H  L  *  A  N  A  I  S  Q  *  T  H  H  *  L  A  K
       R  F  N  T  Y  N  H  M  Q  L  P  N  N  H  I  T  S  Y  H  R
         S  I  L  T  I  I  C  K  C  H  I  T  I  Y  P  A  I  I  G  K

9841   AACCAAAACACAGTGTATACATCGATACCAATAACGTTTGGTACAAAATACCAATAAAAG   9900
        K  T  K  H  *  M  H  L  *  P  *  Q  L  G  H  K  I  T  I  K
       K  P  K  T  D  C  I  Y  S  H  N  N  C  V  M  N  *  P  *  K
         Q  N  Q  T  V  Y  T  A  I  T  I  A  F  W  T  K  H  N  N  E

9901   TATAACATCCTTTTAACCACAATTACATACATCACTATCATGTAAACTTCTTTGTAGAGA   9960
        M  N  Y  S  F  Q  H  *  H  I  Y  H  Y  Y  M  Q  L  F  M  E
       *  I  T  P  F  N  T  N  I  Y  T  T  I  T  C  K  F  F  C  R
         Y  Q  L  F  I  P  T  L  T  H  L  S  L  V  N  S  S  V  D  R

9961   ATGATGAAAATACTAATGATTTCTAAGAATAACATCTAATTTCTTAAGACAAAGACTACA   10020
        *  *  K  *  S  *  *  L  N  K  N  Y  I  L  S  N  Q  K  Q  H
       K  S  S  K  H  N  S  F  I  R  I  T  S  *  L  I  R  N  R  I
         V  V  K  I  I  V  L  S  E  *  Q  L  N  F  F  E  T  E  S  T

10021  ACGGATGTTATCTATAAACTCAAACATATTATTCATAGCAATGATATCACCATTTTACCT   10080
        Q  R  C  Y  I  N  S  N  T  Y  Y  T  D  N  S  Y  H  Y  F  P
       N  G  V  I  S  I  Q  T  Q  I  I  L  I  T  V  I  T  T  F  H
         A  *  L  L  Y  K  L  K  Y  L  L  Y  R  *  *  L  P  L  I  S

10081  ATGACGACGGATATCTCTTCGCCGCACAAGAGTCAATCGATTTCGATACCTTTGTAAATT   10140
        Y  Q  Q  R  Y  L  L  P  T  N  E  T  L  *  L  *  P  F  M  *
       I  S  S  G  I  S  F  R  R  T  R  L  *  S  F  S  H  F  C  K
         V  A  A  *  L  S  A  A  H  E  *  N  A  L  A  I  S  V  N  L

10141  AGTGTTATTACCATTACTACAGAATATGGTTGGAGGATGTCGTAGACAAAGATGTAGAAA   10200
        D  C  Y  H  Y  H  H  R  I  G  V  E  *  L  M  Q  K  *  M  K
       I  V  I  I  T  I  I  D  *  V  L  R  R  C  C  R  N  R  C  R
         *  L  L  P  L  S  T  K  Y  W  G  G  V  A  D  T  E  V  D  K

10201  AAACGTTAGTCCATAACATTTCTACCATAGAGGATGCAGTTTTTAACTTGGAACATAACA   10260
        K  A  I  L  Y  Q  L  S  P  I  E  *  T  L  F  Q  V  K  Y  Q
       K  Q  L  *  T  N  Y  L  H  Y  R  R  R  *  F  N  F  R  T  N
         K  C  D  P  I  T  F  I  T  D  G  V  D  F  I  S  G  Q  I  T
```

FIG. 3 CONT'D

10261 ATCACAATGAATACCATCATACTGAAACTTACCAAATACCAATCTACTGTTTCAAATAAC 10320
* H * K H Y Y S K S H N I T L H C L K N
N T N S I T T H S Q I T * P * I V F N I
L T V * P L I V K F P K H N S S L T * Q

10321 AGGAGCAGTACAATATACAAGTAGGAGATTATACTTGCTTGGACTAATAAGACGGAATAA 10380
D E D H * I N M R * Y S R V Q N N Q R I
T R T M N Y T * G R I H V F R I I R G *
G R * T I H E D E L I F S G S * E A K N

10381 CACATCTCAATGAGATCCACTAAAATGATATTACAGACCAGCCTACTCAAATTGTCAACA 10440
T Y L * E L H N * * L T Q D S S N L L Q
Q T S N S * T I K S Y H R T P H T * C N
H L T V R P S K V I I D P R I L K V T T

10441 CAGAATGGTCTACGTCCCGACAGTTGAACAAAACTGTCAGAGAAATGTTTTAGGAATGTG 10500
T K G S A P S D V Q K S L R K V F D K C
H R V L H L A T L K N Q C D R * L I R V
D * W I C P Q * S T K V T E K C F G * V

10501 AGGTTTTATATGAAAACCATTACAATTTGGACCACTTTGAAAATGACAAAATCGACGCAT 10560
E L I Y K Q Y H * V Q H F K * Q K L Q T
S W F I S K T I N F R T F S K S N * S R
G F Y V K P L T L G P S V K V T K A A Y

10561 ATTACCGGCTGGTGTTCCCCGTAAAGTACAATGATACGCATCATCAATATGATAATTTCC 10620
Y H G V V L P M E H * * A Y Y N Y * * L
I I A S W L P C K M N S H T T T I S N F
L P R G C P A N * T V I R L L * V I L P

10621 AAGAAAAAACACACCCAGTACACCTAGACAACCAATACATAATTGTCCACTATCACAATT 10680
N K K T H T M H I Q Q N H I L L H Y H *
T R K Q T P * T S R N T I Y * C T I T N
E K K H P D H P D T P * T N V P S L T L

10681 CAAACATATATACGTAGTTAATCTCGAGTCATGACCAACAGTGTGACCGTGACTAAAATG 10740
T Q I Y A D I L A * Y Q N D C Q C Q N *
L K Y I H M L * L E T S T T V S A S I K
N T Y I C * N S S L V P Q * V P V S K V

10741 ACCATTAAAAATACCAGGTATATCTCTACGAGTTCAACATGTCAACGGTCAATTCCTGAT 10800
Q Y N K H D M Y L H E L Q V T A L * P S
S T I K I T W I S I S L N Y L Q W N L V
P L K * P G Y L S A * T T C N G T L S *

FIG. 3 CONT'D

```
10801 GCAGGTCTGACAATTACAATAACGAACCGAGATACGTCGATATGAATTATTAACACGAAC 10860
       R  G  S  Q  *  H  *  Q  K  A  R  H  L  *  V  *  Y  N  H  K
      V  D  L  S  N  I  N  N  S  P  E  I  C  S  Y  K  I  I  T  S
        T  W  V  T  L  T  I  A  Q  S  *  A  A  I  S  L  L  Q  A  Q

10861 CAAACATGTTTTACTACAAACAAGATGACTTCTAAAATTACAAACCCGATACCGTTTACC 10920
       T  Q  V  F  H  H  K  N  *  Q  L  N  *  H  K  P  *  P  L  H
      P  K  Y  L  I  I  N  T  R  S  F  I  K  I  N  P  S  H  C  I
        N  T  C  F  S  T  Q  E  V  S  S  K  L  T  Q  A  I  A  F  P

10921 AAAATCGGTTCATTTTCGTCTAGAACAGAATCTACGAAACCGAAGTTACTGTCCACAAAG 10980
       N  *  G  L  L  L  L  D  Q  R  L  H  K  P  K  L  S  L  H  K
      T  K  A  L  Y  F  C  I  K  D  *  I  S  Q  S  *  H  C  T  N
        K  L  W  T  F  A  S  R  T  K  S  A  K  A  E  I  V  P  T  E

10981 ATAACTTTGAAATAACCGACGATAATTCGCAGATATATACCCTAAAGTTCCAGCAGTTTA 11040
       *  Q  F  K  I  P  Q  *  *  A  D  I  Y  P  I  E  L  D  D  F
      R  N  F  S  *  Q  S  S  N  L  T  *  I  H  S  K  L  T  T  L
        I  S  V  K  N  A  A  I  L  R  R  Y  I  P  N  *  P  R  *  I

11041 TGATCCTTCAACATGAAAACTTCTACTTAACCGTGGAAGACTGCAAATAGTTGTTAACCG 11100
       V  L  F  N  Y  K  Q  L  H  I  P  V  K  Q  R  K  D  V  I  P
      Y  *  S  T  T  S  K  F  I  F  Q  C  R  R  V  N  I  L  L  Q
        S  P  L  Q  V  K  S  S  S  N  A  G  E  S  T  *  *  C  N  A

11101 ACCACAATTTAACGTTAGATTTTGTTTTTCTAAATAATTTCTTTGTTAAATAACCTAAAA 11160
       Q  H  *  I  A  I  *  F  L  F  I  *  *  L  F  L  K  N  S  K
      S  T  N  F  Q  L  R  F  C  F  S  K  N  F  F  C  N  I  P  N
        P  T  L  N  C  D  L  V  F  L  N  I  L  S  V  I  *  Q  I  K

11161 CTATAGATGTAAAAACAAATCAACATATTAAAGACGTAAACAATTTACCTGATATAAATA 11220
       S  I  *  M  K  T  *  N  Y  L  K  Q  M  Q  *  I  S  *  I  *
      Q  Y  R  C  K  Q  K  T  T  Y  N  R  C  K  N  F  P  S  Y  K
        I  D  V  N  K  N  L  Q  I  I  E  A  N  T  L  H  V  I  N  I

11221 CATATAATTATGTGTATACTAACCACAATGTAATACACATGAAACAAAACAATCAAAATA 11280
       T  Y  *  Y  V  Y  S  Q  H  *  M  I  H  V  K  N  Q  *  N  *
      H  I  N  I  C  M  H  N  T  N  C  *  T  Y  K  T  K  N  T  K
        Y  I  L  V  C  I  I  P  T  V  N  H  T  S  Q  K  T  L  K  I

11281 CTACAATGATCAATTTGTATTCGTAAAAATAAACTGATACATATATTAAGGACATGAGAC 11340
       S  T  V  L  *  V  Y  A  N  K  N  S  *  T  Y  L  E  Q  V  R
      H  H  *  *  N  F  M  L  M  K  I  Q  S  H  I  Y  N  R  Y  E
        I  N  S  T  L  C  L  C  K  *  K  V  I  Y  I  I  G  T  S  Q
```

FIG. 3 CONT'D

11341 ATGGAACAAAATACATTTAATAAATCAACAAATATTCCTTCCAAAATCTCCAAAATGAAT 11400
Y R T K H L N N L Q K Y P L N * L N * K
T G Q K I Y I I * N N I L F T K S T K S
V K N * T F * K T T * L S P K L P K V *

11401 ACAGACCGAGAGTATAAAACAAGGACGACACTTAAAATGAATACAAATACTTCATAAAAT 11460
H R A R M N Q E Q Q S N * K H K H L I K
I D P E * I K N R S H I K S I N I F Y K
T Q S E Y K T G A T F K V * T * S T N *

11461 ACCAACATAAAATACACAAAAACGATAAAAATATTGATACGTATCATAATTAGTACTGTA 11520
H N Y K I H K Q * K * L * A Y Y * D H C
I T T N * T N K S N K Y S H M T N I M V
P Q I K H T K A I K I V I C L I L * S M

11521 AAAAAGAAACTACAAAAACCAACCATCTTATCAATGAAATTAAAGATACACCATAAAACC 11580
K K K S T K P Q Y F L * K L K * T T N Q
N K R Q H K Q N T S Y N S * N R H P I K
K E K I N K T P L I T V K I E I H Y K P

11581 CAGCTTAAATCTTCTCCTACAAAACAATAAATAATGTCGGAAAAATCCATGAATATGTAC 11640
T S N L L P H K T I * * L R K L Y K Y M
P R I * F L I N Q * K N C G K * T S I C
D F K S S S T K N N I V A K K P V * V H

11641 CTGGTGATAAAACAGTAATCGATATCGTTTTTAACAACGATTAACCAACAGACAATTATA 11700
S W * K T M L * L L F Q Q * N T T Q * Y
P G S N Q * * S Y C F N N S I P Q R N I
V V I K D N A I A F I T A L Q N D T L I

11701 TAAAATAAAATGTCTACATGGAATATAATTTAACTAAGAGAACTCAATGAATAAATATCC 11760
I K N * L H V K Y * I S E R S N S I * L
Y K I K C I Y R I N F Q N E Q T V * K Y
N * K V S T G * I L N I R K L * K N I P

11761 CATATAAAATAGAACAATAACCCCTAAAAAGAGAGAAAATTTGTCACAAAAATCTTACGG 11820
T Y K I K N N P I K R E K L C H K * F A
P I N * R T I P S K E R K * V T N K S H
Y I K D Q * Q P N K E R K F L T K L I G

11821 ATACCCACAAATATTAATATTTTAAAGACAAGTTCTTAACGCAATATACTTACGATTACC 11880
* P H K Y N Y F K Q E L I A N Y S H * H
R H T N I I I F N R N L F Q T I H I S I
I P T * L * L I E T * S N R * I F A L P

FIG. 3 CONT'D

```
11881 GAATGCAGGTGGAGCATTATCAAAACTCCGATAAAACAATTTAAATTTTGACGAACCTTA 11940
       S  V  D  V  E  Y  Y  N  Q  P  *  K  T  L  N  L  V  A  Q  F
      A  *  T  W  R  T  I  T  K  L  S  N  Q  *  I  *  F  Q  K  S
        K  R  G  G  R  L  L  K  S  A  I  K  N  F  K  F  S  S  P  I

11941 TCCACCGCACGGTCAATAACTTCAGAGGGTTTAAGTTAGTTTTAACTGACTACACTTTAC 12000
       L  H  R  A  L  *  Q  L  R  G  F  E  I  L  I  S  Q  H  S  I
      Y  T  A  H  W  N  N  F  D  G  L  N  L  *  F  Q  S  I  H  F
        P  P  T  G  T  I  S  T  E  W  I  *  D  F  N  V  S  T  F  H

12001 ACGATTACAACAAAACAATTTAACAAATGTCGTAAACGTACAACGAAGATTAAGATTCAA 12060
       H  *  H  Q  K  T  L  N  N  V  A  N  A  H  Q  K  *  N  *  T
      T  S  I  N  N  Q  *  I  T  *  L  M  Q  M  N  S  R  I  R  L
        A  L  T  T  K  N  F  Q  K  C  C  K  C  T  A  E  L  E  L  N

12061 CACCGTCATAACATCACAAAATGTATTACTTTATGATAGATGAAGTCTAAACTCACATCG 12120
       T  A  T  N  Y  H  K  V  Y  H  F  V  I  *  K  L  N  S  H  L
      Q  P  L  I  T  T  N  *  M  I  F  Y  *  R  S  *  I  Q  T  Y
        H  C  Y  Q  L  T  K  C  L  S  I  S  D  V  E  S  K  L  T  A

12121 AAAACTATTCGAACGAGTTAATAACTAACAAAATAAGCGGTTAGGACGACGTCAACTATG 12180
       K  Q  Y  A  Q  E  I  I  S  Q  K  I  R  W  D  Q  Q  L  Q  Y
      S  K  I  L  K  S  L  *  Q  N  N  *  E  G  I  R  S  C  N  I
        K  S  L  S  A  *  N  N  I  T  K  N  A  L  G  A  A  T  S  V

12181 ATTCACAGAACGTTCATATCTACTTCAATCGCTACTAATACAAGTTCTATCATGGCAAAA 12240
       *  T  D  Q  L  Y  L  H  L  *  R  H  N  H  E  L  Y  Y  R  K
      S  L  T  K  C  T  Y  I  F  N  A  I  I  I  N  L  I  T  G  N
        L  H  R  A  L  I  S  S  T  L  S  S  *  T  *  S  L  V  T  K

12241 CGTCCGAAACGTTTCACTCAAACATTTATACCGATCAAAACAACTTATACTTCAGCGTTT 12300
       A  P  K  A  F  H  T  Q  L  Y  P  *  N  Q  Q  I  H  L  R  L
      Q  L  S  Q  L  T  L  K  Y  I  H  S  T  K  N  F  I  F  D  C
        C  A  K  C  L  S  N  T  F  I  A  L  K  T  S  Y  S  T  A  F

12301 CTTTTTAAACCGACTACGATTTTTATCACCAAGACAATTAGTTGTTGTCTATTTTGTCAA 12360
       S  F  N  P  Q  H  *  F  Y  H  N  Q  *  D  V  V  S  L  V  T
      L  F  I  Q  S  I  S  F  I  T  T  R  N  I  L  L  L  Y  F  L
        F  F  K  A  S  A  L  F  L  P  E  T  L  *  C  C  I  F  C  N

12361 TCTTTTTCGTACATTATATCGATTCAGACACATACTTGCACTATTTCGACATCGAGCGTT 12420
       L  F  L  M  Y  Y  L  *  T  Q  T  H  V  H  Y  L  Q  L  E  C
      *  F  F  C  T  I  Y  S  L  R  H  I  F  T  I  F  S  Y  S  A
        S  F  A  H  L  I  A  L  D  T  Y  S  R  S  L  A  T  A  R  L
```

FIG. 3 CONT'D

12421 TGAACTTGCATACCGTCTGGATCGTGAATGATTGTACATATTTCTCCGAGCCTAATTACT 12480
V Q V Y P L G L V * * C T Y L P E S * H
F K F T H C V * C K S V H I F L S P N I
S S R I A S R A S V L M Y L S A R I L S

12481 ATTCTTCTCATTTCAACAAAGGCGAAACGTCTGTTACGAAAAATCGTACCAAGCATTTAA 12540
Y S S Y L Q K R K A S L A K * C P E Y I
I L L T F N N G S Q L C H K K A H N T F
L F L L T T E A K C V I S K L M T R L N

12541 CCTATTAGTCCGAAATTTAAGATAAGACCTATTACGACAATTTCCAACACATGGAAACTC 12600
P Y D P K L N * E P Y H Q * L N H V K S
Q I I L S * I R N Q I I S N F T T Y R Q
S L * A K F E I R S L A T L P Q T G K L

12601 ACGATAAGGTCGTAACCGACGATTATGAAATTGATATCATTATGGTCTATTTGTTCAAAA 12660
H * E L M P Q * Y K L * L L V L Y V L K
T S N W C Q S S I S * S Y Y Y W I F L N
A I G A N A A L V K V I T I G S L C T K

12661 ACTATTTCAACAACTATTACAAATACAATGTATACGACCATCACATACCGTATATGTCTG 12720
Q Y L Q Q Y H K H * M H Q Y H I A Y V S
K I F N N I I N I N C I S T T Y P M Y L
S L T T S L T * T V Y A P L T H C I C V

12721 ACAAGTTCTACGACTACCATAATTATTTGTCAATTGACTATAATCACAACTAAGATTAAC 12780
Q E L H Q H Y * Y V T L Q Y * H Q N * N
S N L I S I T N I F L * S I N T N I R I
T * S A S P I L L C N V S I L T S E L Q

12781 CGGAGAACAATAGTAACGCTTGTCCATATTACTTCAACGATTACGACAATACGTCTTATT 12840
A E Q * * Q S C T Y H L Q * H Q * A S Y
P R K N D N R V P I I F N S I S N H L I
G R T I M A F L Y L S T A L A T I C F L

12841 ACTCAACTACGGAGTATTTAATTTTTATGTTCAACAATTATCACCAAGACTATACTTAAC 12900
H T S A E Y I L F V L Q * Y H N Q Y S N
I L Q H R M F * F Y L N N I T T R I H I
S N I G * L N F I C T T L L P E S I F Q

12901 ATTATAAGGATGAGTTACAATAATATTATTACCATCATCACCATCTTATCAAATACGACA 12960
Y Y E * E I N N Y Y H Y Y H Y F L K H Q
T I N R S L T I I I I T T T T S Y N I S
L I G V * H * * L L P L L P L I T * A T

FIG. 3 CONT'D

```
12961  AGAATCACTACAACTACCAGAATTCATATGATTCTATTACTTTCTACTACCTTTAACACA  13020
        E  *  H  H  Q  H  D  *  T  Y  *  S  L  S  L  H  H  F  N  H
       N  K  T  I  N  I  T  K  L  I  S  L  Y  H  F  I  I  S  I  T
         R  L  S  T  S  P  R  L  Y  V  L  I  I  F  S  S  P  F  Q  T

13021  ACAAAATCTCGAACTAGGAGGAACATTTAAAAGATATGTTCTACAATTCCCTGAATTTTA  13080
        Q  K  L  A  Q  D  E  K  Y  I  K  *  V  L  H  *  P  V  *  F
       N  N  *  L  K  I  R  R  T  F  K  R  Y  L  I  N  L  S  K  F
         T  K  S  S  S  G  G  Q  L  N  E  I  C  S  T  L  P  S  L  I

13081  ATTCATAGAAATAAAATAATTTCCTACATTGTGAAATCGATCTCCCACCCAACAACCATG  13140
        *  T  D  K  N  *  *  L  I  Y  C  K  L  *  L  T  P  Q  Q  Y
       N  L  I  K  I  K  N  F  S  T  V  S  *  S  S  P  P  N  N  T
         L  Y  R  *  K  I  L  P  H  L  V  K  A  L  P  H  T  T  P  V

13141  AAATAGAAGTTGTTAATCTAACGTCCGACCACAACGATGACTCATACGTCGATTAAGAAG  13200
        K  I  K  L  L  *  I  A  P  Q  H  Q  *  Q  T  H  L  *  N  K
       S  *  R  *  C  N  S  Q  L  S  T  N  S  S  L  I  C  S  I  R
         K  D  E  V  I  L  N  C  A  P  T  A  V  S  Y  A  A  L  E  E

13201  ATATGAAAGTAATACACGTAAAAGACATCTAGGATTCTTTTGAATAAATCTAATATATGT  13260
        *  V  K  M  I  H  M  K  Q  L  D  *  S  F  K  N  L  N  Y  V
       R  Y  K  *  *  T  C  K  R  Y  I  R  L  F  S  I  *  I  I  Y
         I  S  E  N  H  A  N  E  T  S  G  L  F  V  *  K  S  *  I  C

13261  TGTTCCACCACATGGATATTAATTAACACAATTTTACGAGACACTAGTACGACCATGACC  13320
        V  L  H  H  V  *  L  *  N  H  *  F  A  R  H  D  H  Q  Y  Q
       L  L  T  T  Y  R  Y  N  I  T  N  F  H  E  T  I  M  S  T  S
         C  P  P  T  G  I  I  L  Q  T  L  I  S  Q  S  *  A  P  V  P

13321  ATACCGGTAATGATAATTTGGACTCCGATGATAATTGGTTCTAAGAATACCACCACGGAG  13380
        Y  P  W  *  *  *  V  Q  P  *  *  *  G  L  N  K  H  H  H  R
       T  H  G  N  S  N  F  R  L  S  S  N  V  L  I  R  I  T  T  G
         I  A  M  V  I  L  G  S  A  V  I  L  W  S  E  *  P  P  A  E

13381  TCAAACATAAATAACGGCACGTGCACATCTCGTAGGTCTACATCTACCATATACATTTAA  13440
        L  K  Y  K  N  G  H  V  H  L  A  D  L  H  L  H  Y  I  Y  I
       *  N  T  N  I  A  T  C  T  Y  L  M  W  I  Y  I  T  Y  T  F
         T  Q  I  *  Q  R  A  R  T  S  C  G  S  T  S  P  I  H  L  N

13441  TGCACCATTTAAACATGTTCAGGGAAACCCATATTTTCTAGGATAAGAAATACACAATTG  13500
        V  H  Y  I  Q  V  L  G  K  P  Y  L  L  D  *  E  K  H  T  L
       *  T  T  F  K  Y  L  D  R  Q  T  Y  F  I  R  N  K  I  H  *
         R  P  L  N  T  C  T  G  K  P  I  F  S  G  I  R  *  T  N  V
```

FIG. 3 CONT'D

13501 TGTACTACAAACAGTTCAGACACCAAAAACCTCTCTACCGTCAACAAGGACACATCCAAG 13560
V H H K D L R H N K S L H C N N R H L N
C M I N T L D T T K P S I A T T G T Y T
C S T Q * T Q P K Q L S P L Q E Q T P E

13561 TTCACAGCGACAAGTTAGATTTCTAAATTTAAAAAATTTGCCCAAGCCCCATGATCACAC 13620
L H R Q E I * L N L N K L R T R P V L T
* T D S N L R F I * I K * V P E P Y * H
L T A T * D L S K F K K F P N P T S T H

13621 TTACGGGCCGATCATGGGACACGATCACCAAATAGATGACTACAAGTTAATTCCCGTAAA 13680
F A R S T G Q A L P K D V S T * N L A N
S H G A L V R H * H N I * Q H E I L P M
I G P * Y G T S T T * R S I N L * P C K

13681 CTGTAAACATTATGGTTATCTCGACCATATCCAAATATAATATTTCACTTAACAACGGCA 13740
S M Q L V L L A P I P K Y * L T F Q Q R
Q C K Y Y W Y L Q Y L N I N Y L S N N G
V N T I G I S S T Y T * I I F H I T A T

13741 AAAGTCGCATATCTACTGCTGCCATTATTTAACCTATTCAAGAAACAACAGTTTTCTTGA 13800
K * R I S S S P L L N S L N K T T L L V
N E A Y L H R R Y Y I P Y T R Q Q * F F
K L T Y I V V T I F Q I L E K N D F S S

13801 TTAAATCTTCAAATATTATTTCTCTTTTGAATAATACTCAACTGATTTTCAACACCACAA 13860
L K S T * L L S F V * * S N V L L Q P T
* N L L K Y Y L S F K N H T S * F N H H
I * F N I I F L F S I I L Q S F T T T N

13861 CACCGACTTGTACTAAAGAAATGTAAACTATAACTACCATCAGCGCACGGTGTATATCAA 13920
T A S C S K K V N S I S P L R T G C I T
Q P Q V H N R * M Q Y Q H Y D R A V Y L
H S F M I E K C K I N I T T A H W M Y N

13921 GCATCCTTAGAAAGTTTCATATGATACAATCTAGAAACGATACGTAACGCAGTAAAACTA 13980
R L F R E F Y V I N S R Q * A N R * K S
E Y S D K L T Y * T L D K S H M A D N Q
T P I K * L I S H * I K A I C Q T M K I

13981 GCATTACTAACAAGTTATAACACACTTTAAGAAACACTCATACGACTAACATTTCTTAGG 14040
R L S Q E I N H S I R Q S Y A S Q L S D
D Y H N N L I T H F E K H T H Q N Y L I
T I I T * Y Q T F N K T L I S I T F F G

FIG. 3 CONT'D

```
14041  ATGAAAAGATTCTTTCTAACCATACTAAAACAACTTTTAGGACTATAATAATTATATATA  14100
        * K E L F S Q Y S K T S F G S I I L I Y
       R S K * S L N T H N Q Q F D Q Y * * Y I
         V K R L F I P I I K N F I R I N N I Y I

14101  TTTTTAATCCGGGATAAAAATTATCTCGAAATGAATTATGACAGTAAAAACGTCTGTGG  14160
        L F N P G I K L L A K S L V T M K A S V
       Y F I L G * K * Y L K V * Y Q * K Q L C
         F F * A R N K I S S * K I S D N K C V G

14161  AATCAACTTCATCCAAATCAACCACAAAATTGAAATCTATTGGTTCTAAACATACCAGTT  14220
        K T S T P K T P T K V K S L W S K Y P *
       R L Q L L N L Q H K L K L Y G L N T H D
         * N F Y T * N T N * S * I V L I Q I T L

14221  ACCATACTAAAACCACTAAAATATGTTTGTCGGGGTCCCAAACCACACCGTCAACGTCTA  14280
        H Y S K P S K I C V A G P N P T A T A S
       I T H N Q H N * V F L G L T Q H P L Q L
         P I I K T I K Y L C G W P K T H C N C I

14281  AGAATGATAAGAATATACTACGGATACAACTGATACACAGTACATAATCTAACACTTAAT  14340
        E * * E * I I G I N V I H * T N S Q S N
       N K S N K Y S A * T S * T D H I L N H I
         R V I R I H H R H Q S H T M Y * I T F *

14341  AAACAATTACTATCAATATCTGTTAAGCTAGAACATGTCATACTAAAATGACTAATGTTC  14400
        N T L S L * L C N S R T C Y S K V S * L
       I Q * H Y N Y V I R D Q V T H N * Q N C
         K N I I T I S L E I K Y L I I K S I V L

14401  AATCTCAACAAATTATTCATAAAATTCATAACCCCATACTTCATAGTAGGATTATGACAC  14460
        N S N N L L Y K L Y Q P I F Y * G L V T
       T L T T * Y T N * T N P Y S T D D * Y Q
         * L Q K I L I K L I P T H L I M R I S H

14461  CTAACACTATTACTATCCACATAATAAGTAACACGATTAAAATTATATGATAAATCATAC  14520
        S Q S L S L H I I * Q A L K L I S N L I
       P N H Y H Y T Y * E N H * N * Y V I * Y
         I T I I I P T N N M T S I K I Y * K T H

14521  CAAAATGGATTATGAACAAAACCAGGGGAACAATCTGTTTAAAAACATCTACCACATGGC  14580
        T K G L V Q K P G R T L C I K T S P T G
       P K V * Y K N Q D G Q * V F K Q L H H V
         N * R I S T K T G K N S L N K Y I T Y R
```

FIG. 3 CONT'D

```
14581  AAACAACAAAGATAACCAATGGTAATGTTTCTCAATCCACATCAATACTTGAATCTACAA  14640
        N  T  T  E  I  P  *  W  *  L  S  N  P  T  T  I  F  K  S  T
       T  Q  Q  K  *  Q  N  G  N  C  L  T  L  H  L  *  S  S  L  H
         K  N  N  R  N  T  V  M  V  F  L  *  T  Y  N  H  V  *  I  N

14641  CTGTGTGTGGCAATAGCAAACAGAGAATTTCTAAATGAAGAAATACGTCGTCTAGGACGA  14700
        S  V  C  R  *  R  K  D  R  L  S  K  S  R  *  A  A  S  G  A
       Q  C  V  G  N  D  N  T  E  *  L  N  V  E  K  H  L  L  D  Q
         V  C  V  T  I  T  Q  R  K  F  I  *  K  K  I  C  C  I  R  S

14701  TACGTGCAACGTAGACGATCACGAGACGAACTAAATGCTTGAACAACAAAATCACATCGA  14760
        I  C  T  A  D  A  L  A  R  S  S  K  R  V  Q  Q  K  L  T  A
       *  A  R  Q  M  Q  *  H  E  A  Q  N  V  F  K  N  N  *  H  L
         H  V  N  C  R  S  T  S  Q  K  I  *  S  S  T  T  K  T  Y  S

14761  CGGTAATGTTCACCATATTTTAAAGTTTGACATTTTGGTCCATTGAAATTGGTTCTGAAA  14820
        A  M  V  L  P  I  F  N  *  V  T  F  G  P  L  K  L  W  S  K
       Q  W  *  L  H  Y  L  I  E  F  Q  L  V  L  Y  S  *  G  L  S
         G  N  C  T  T  Y  F  K  L  S  Y  F  W  T  V  K  V  L  V  K

14821  ATGCTCAAACAATTTTCATTTCCGAACAAATTTCTCCCATCATGTCAACTAAACTTTGTA  14880
        *  S  N  T  L  L  L  P  K  N  L  S  P  L  V  T  S  K  F  C
       K  R  T  Q  *  F  Y  L  S  T  *  L  P  Y  Y  L  Q  N  S  V
         V  L  K  N  F  T  F  A  Q  K  F  L  T  T  C  N  I  Q  F  M

14881  AAAAAGAAATGAGTTCTACCATTACGACGTTAATGACTAATATTAATAATATTCATATTA  14940
        K  K  K  V  *  S  P  L  A  A  I  V  S  *  L  *  *  L  Y  L
       N  K  R  *  E  L  H  Y  H  Q  L  *  Q  N  Y  N  N  Y  T  Y
         K  E  K  S  L  I  T  I  S  C  N  S  I  I  I  I  I  L  I  I

14941  AATGGATGATACCAACTATAATTCGTCAATAACAAACATAATCTTCAACAAATATTTATA  15000
        K  G  V  I  T  S  I  L  C  N  N  N  T  N  S  T  T  *  L  Y
       N  V  *  *  P  Q  Y  *  A  T  I  T  Q  I  L  L  Q  K  Y  I
         *  R  S  H  N  I  N  L  L  *  Q  K  Y  *  F  N  N  I  F  I

15001  AAACTTTAAATACTACCACCAACATATGGTCGTAGTGTTCAATAACAATTATTAATACTA  15060
        K  S  I  *  S  P  P  Q  I  G  A  D  C  T  I  T  L  L  *  S
       N  Q  F  K  H  H  H  N  Y  V  L  M  V  L  *  Q  *  Y  N  H
         K  F  N  I  I  T  T  T  Y  W  C  *  L  N  N  N  I  I  I  I

15061  TTTTCACGACCAATAGGTAAATTATTTAAACCATTTCGGTCTGAAATAATACTCCGTAAT  15120
        L  L  A  P  *  G  N  L  L  N  P  L  A  L  S  *  *  S  A  N
       Y  F  H  Q  N  D  M  *  Y  I  Q  Y  L  W  V  K  N  H  P  M
         F  T  S  T  I  W  K  I  F  K  T  F  G  S  K  I  I  L  C  *
```

FIG. 3 CONT'D

```
15121  AGTAAACTCCTTGTCTTACTTTAAATACGTATATGATTTGCATTACAAGACGGGTGGAAT  15180
        D  N  S  S  C  F  S  I  *  A  Y  V  L  R  L  T  R  G  V  K
       I  M  Q  P  V  S  H  F  K  H  M  Y  *  V  Y  H  E  A  W  R
         *  K  L  F  L  I  F  N  I  C  I  S  F  T  I  N  Q  G  G  *

15181  TGAGTTTACTTAAATTTTATACGATAGTCACGATTCTTATCTCGAGCGTGACATCGTCCA  15240
        V  *  I  F  K  F  Y  A  I  L  A  L  F  L  A  R  V  T  A  P
       L  E  F  S  N  L  I  H  *  *  H  *  S  Y  L  E  C  Q  L  L
         S  L  H  I  *  F  I  S  D  T  S  L  I  S  S  A  S  Y  C  T

15241  CAAAGATAAGAATCATGATACTGTCCGGCTTACAAGGTAGTTTTTACAAACTTCTCATAT  15300
        T  E  I  R  L  V  I  V  P  R  I  N  W  *  F  H  K  F  L  I
       H  K  *  E  *  Y  *  S  L  G  F  T  G  D  F  I  N  S  S  Y
         N  R  N  K  T  S  H  C  A  S  H  E  M  L  F  T  Q  L  T  Y

15301  CGTCGATGGGCTCCACAAGGACAACAATATCCTTGGTGATTTAAAATACCACCAACCCTG  15360
        A  A  V  R  P  T  G  T  T  I  P  V  V  L  N  *  P  P  Q  S
       L  L  *  G  L  H  E  Q  Q  *  L  F  W  *  I  K  H  H  N  P
         C  S  G  S  T  N  R  N  N  Y  S  G  S  F  K  I  T  T  P  V

15361  CTATACAATGCAGTAGAATATTTCCTACAACTGTTGGGACAAGAATACCCAACCCTAATA  15420
        S  I  N  R  *  R  I  F  S  T  S  L  G  T  R  I  P  Q  S  *
       R  Y  T  V  D  D  *  L  P  H  Q  C  G  Q  E  *  P  N  P  N
         I  H  *  T  M  K  Y  L  I  N  V  V  R  N  K  H  T  P  I  I

15421  GGATTTACACTAGCACGATACGGTTTATAAAACGCATAACAATCATCAAATCAAAACCGG  15480
        G  L  H  S  R  A  I  G  F  I  K  R  I  T  L  L  K  T  K  A
       D  *  I  H  D  H  *  A  L  Y  K  A  Y  Q  *  Y  N  L  K  P
         R  F  T  I  T  S  H  W  I  N  Q  T  N  N  T  T  *  N  Q  G

15481  GCGTTTGTACTTAAAACAACAAGTGTACCACTATCTAAAATAGCGGAACGCTTACTTACA  15540
        R  L  C  S  N  Q  Q  E  C  P  S  L  N  *  R  R  A  F  S  H
       G  C  V  H  I  K  N  N  V  H  H  Y  I  K  D  G  Q  S  H  I
         A  F  M  F  K  T  T  *  M  T  I  S  K  I  A  K  R  I  F  T

15541  CGAGTTCAAAACTCACTTTATCAATACACACCGCCAACGATAATACAATTCGGACCACCA  15600
        A  *  T  K  L  S  I  T  I  H  P  P  Q  *  *  T  L  G  P  P
       H  E  L  K  S  H  F  L  *  T  H  R  N  S  N  H  *  A  Q  H
         S  L  N  Q  T  F  Y  N  H  T  A  T  A  I  I  N  L  R  T  T

15601  TGATCGTCACCACTACGTTGATGACGAAAACGATTAAGACAAAAATTATATACAGTCCGA  15660
        V  L  L  P  S  A  V  V  A  K  A  L  E  T  K  L  I  H  *  A
       Y  *  C  H  H  H  L  *  Q  K  Q  *  N  Q  K  *  Y  I  D  P
         S  A  T  T  I  C  S  S  S  K  S  I  R  N  K  I  Y  T  L  S
```

FIG. 3 CONT'D

```
15661 CAATGACGATTACAAACAAGAGAATACCGGACATTACCGGTATTCTAACTTCTAAATTCA 15720
       T  V  A  L  T  Q  E  R  I  A  Q  L  P  W  L  I  S  S  K  L
      Q  *  Q  *  H  K  N  E  *  P  R  Y  H  G  Y  S  Q  L  N  L
        N  S  S  I  N  T  R  K  H  G  T  I  A  M  L  N  F  I  *  T

15721 TATGCGTTAAATGTTTTTGCGAATATGAGATTACAAATAGCATGTCTAATACAACTAATA 15780
       I  R  L  K  C  F  R  K  Y  E  L  T  *  R  V  S  *  T  S  *
      Y  V  C  N  V  F  V  S  I  S  *  H  K  D  Y  L  N  H  Q  N
        Y  A  I  *  L  F  A  *  V  R  I  N  I  T  C  I  I  N  I  I

15781 TGTAAACAATTACTCATAATACTTAAAAATACATTCGTAAAATCATACTACTAAAACTCA 15840
       V  N  T  L  S  Y  *  S  N  K  H  L  C  K  L  I  I  I  K  L
      Y  M  Q  *  H  T  N  H  I  K  I  Y  A  N  *  Y  S  S  K  S
        C  K  N  I  L  I  I  F  K  *  T  L  M  K  T  H  H  N  Q  T

15841 CTACTACCACAACAGACAATATTGAGACTAATACGATCATTCCCAATATATCGATTATAT 15900
       S  S  P  T  T  Q  *  L  E  S  *  A  L  L  P  *  I  A  L  I
      H  H  H  H  Q  R  N  Y  S  Q  N  H  *  Y  P  N  Y  L  *  Y
        I  I  T  N  D  T  I  V  R  I  I  S  T  L  T  I  Y  S  I  Y

15901 TCACAAAAAGTTGTTCAAAACATGATAGTCTTATTACAGAAATACAGACTTAGATTTACA 15960
       L  T  K  *  C  T  K  Y  *  *  F  L  T  K  I  D  S  D  L  H
      L  H  K  E  V  L  K  T  S  D  S  Y  H  R  *  T  Q  I  *  I
        T  N  K  L  L  N  Q  V  I  L  I  I  D  K  H  R  F  R  F  T

15961 ACCCAACTTTTACTATAATGATTACCAGGAGTACTTAAAACAAGGGTTGTATGATACAAT 16020
       Q  T  S  F  S  I  V  L  P  G  *  S  N  Q  E  W  C  V  I  N
      N  P  Q  F  H  Y  *  *  H  D  E  H  I  K  N  G  V  Y  *  T
        P  N  F  I  I  N  S  I  T  R  M  F  K  T  G  L  M  S  H  *

16021 CAATTCTATCTACCACTAATACAAATAAATGGTATAGGTCTAGGAAGATCTTAAAATCCT 16080
       T  L  I  S  P  S  *  T  *  K  G  Y  G  S  G  E  L  I  K  P
      L  *  S  L  H  H  N  H  K  N  V  M  D  L  D  K  *  F  K  L
        N  L  Y  I  T  I  I  N  I  *  W  I  W  I  R  R  S  N  *  S

16081 CGACCAACAAAACAACTACTAAATAACTTCTGACTGTCACAAGAAAACTATCTCGCGAAA 16140
       A  P  Q  K  T  S  S  K  N  F  V  S  L  T  R  K  I  S  R  K
      L  Q  N  N  Q  Q  H  N  I  S  S  Q  C  H  E  K  S  L  A  S
        S  T  T  K  N  I  I  *  Q  L  S  V  T  N  K  Q  Y  L  A  K

16141 CATTCAGATCGATATCTACGAATGGGAAATCATGTAGTACTTTTACTTCTTATGGTTTTT 16200
       T  L  R  A  I  S  A  *  G  K  T  C  *  S  F  S  S  Y  W  F
      Q  L  D  L  *  L  H  K  G  K  L  V  D  H  F  H  L  I  G  F
        Y  T  *  S  Y  I  S  V  R  *  Y  M  M  F  I  F  F  V  L  F
```

FIG. 3 CONT'D

```
16201  CAGAAAGCACATATAAATCTTATATATTTTTTTGACATATTACTAGAACCATGAGTCTAG  16260
        T  K  R  T  Y  K  S  Y  I  F  F  S  Y  L  S  R  P  V  *  I
       L  R  E  H  I  N  L  I  Y  L  F  V  T  Y  H  D  Q  Y  E  S
         D  K  T  Y  I  *  F  I  Y  F  F  Q  I  I  I  K  T  S  L  D

16261  AATCTATCAATATCACAATAAAATTCATGAACACTACCAAATTTCAAATGACTTCTTAGT  16320
        K  S  L  *  L  T  I  K  L  V  Q  S  P  K  F  N  V  S  S  D
       R  L  Y  N  Y  H  *  K  L  Y  K  H  H  N  L  T  *  Q  L  I
         *  I  T  I  T  N  N  *  T  S  T  I  T  *  L  K  S  F  F  *

16321  AAAATGTTCTTATACATAAATTTTTCACGGCACTACGTCTCACATCCACGTACGCAACAA  16380
        N  *  L  F  I  Y  K  F  L  A  T  I  C  L  T  P  A  H  T  T
       M  K  C  S  Y  T  N  L  F  H  R  S  A  S  H  L  H  M  R  Q
         K  V  L  I  H  I  *  F  T  G  H  H  L  T  Y  T  C  A  N  N

16381  ACAAGTAGTGTTTGAAGAAACGCAACACCGTCAACATATGCATTCGGAAACAATACAACA  16440
        Q  E  D  C  V  E  K  R  Q  P  L  Q  I  R  L  G  K  N  H  Q
       K  N  M  V  F  K  K  A  N  H  C  N  Y  V  Y  A  K  T  I  N
         T  *  *  L  S  R  Q  T  T  A  T  T  Y  T  L  R  Q  *  T  T

16441  TTTACAACAATACTGGTACAATACCGTTGATTAGTATTTATACAAAACTCACAGAGTGGA  16500
        L  H  Q  *  S  W  T  I  A  V  L  *  L  Y  T  K  L  T  E  G
       Y  I  N  N  H  G  H  *  P  L  *  D  Y  I  H  K  S  H  R  V
         F  T  T  I  V  M  N  H  C  S  I  M  F  I  N  Q  T  D  *  R

16501  ATGCAAACATTACGTGGATTGACACTACACTCACTACAGTGGTTTAATATAAACCCGCCA  16560
        *  T  Q  L  A  G  L  Q  S  T  L  S  T  V  L  N  Y  K  P  P
       K  R  K  Y  H  V  *  S  H  H  S  H  H  *  W  I  I  N  P  R
         V  N  T  I  C  R  V  T  I  H  T  I  D  G  F  *  I  Q  A  T

16561  TACAGAATGATAACACTTTTGGTATTTGGGGTAATAAGTAAATTCAATCAATACTTACCA  16620
        I  D  *  *  Q  S  F  W  L  G  W  *  E  N  L  N  T  I  F  P
       Y  T  K  S  N  H  F  G  Y  V  G  N  N  M  *  T  L  *  S  H
         H  R  V  I  T  F  V  M  F  G  M  I  *  K  L  *  N  H  I  T

16621  TACCAGAAACCAAACATATTTGTTAGAACGTGCCCAAGTGGAATATATCTACTAAAATTA  16680
        I  T  K  P  K  Y  L  C  D  Q  V  P  E  G  *  I  S  S  K  L
       Y  P  R  Q  N  T  Y  V  I  K  C  P  N  V  K  Y  L  H  N  *
         H  D  K  T  Q  I  F  L  R  A  R  T  *  R  I  Y  I  I  K  I

16681  TTCTATCGATCAACATTTACCTGTCTTCAACTACTAATACAAGACCGTTTACTCACATAA  16740
        L  I  A  L  Q  L  H  V  S  T  S  S  *  T  R  A  F  S  H  I
       Y  S  L  *  N  Y  I  S  L  L  Q  H  N  H  E  P  L  H  T  Y
         L  Y  S  T  T  F  P  C  F  N  I  I  I  N  Q  C  I  L  T  N
```

FIG. 3 CONT'D

16741 CTTGCAAATTTCAATAAACGACGTCTTTGAGTTTTCCGTTGACTTCTCCGAAAATTTGTT 16800
S R K F N N A A S V * F A V S S A K L C
Q V N L T I Q Q L F E F P L Q L P K * V
F T * L * K S C F S L L C S F L S K F L

16801 TCGATACGAAGACGATGGTAAGTTCTCTAACAATCACTATCTCTTCAATAAAACACAACC 16860
L * A E A V M * S I T L S L S T I K H Q
F S H K Q * W E L S Q * H Y L L * K T N
A I S R S G N L L N N T I S F N N Q T P

16861 CTCTGTCCATTTCAATTTGGTGGTGAATTATTTTTAATACAAAAGTGTCCGATGGTAAAA 16920
S V P L T L G G S L L F * T K V P * W K
P S L Y L * V V V * Y F N H K * L S G N
L C T F N F W W K I F I I N E C A V M K

16921 TGATCATGACCATTCTGTCAAAATCCACTCATACAAAAACTATTTTCACTTAATTGATTG 16980
V L V P L V T K P S Y T K S L L S N V L
* * Y Q Y S L K L H T H K Q Y F H I L *
S T S T L C N * T L I N K I F T F * S V

16981 CCACACATAATGGCGCGATGTTGATGAATATTTGAAAGATATCCACTACAAAAACAAAAT 17040
P T Y * R A V V V * L S E I P S T K T K
R H T N G R * L * K Y V K * L H H K Q K
T H I V A S C S S I F K R Y T I N K N *

17041 TGTAGTGTAAGACATCGATCAAATTCACGTGGATGTGAACAGGGTGTTCTCTTGATACGA 17100
V D C E T A L K L A G V S T G C S F * A
L M V N Q L * N L H V * V Q G V L S S H
C * M R Y S T * T C R C K D W L L V I S

17101 TCATATTCTAAAAGATCACAAATATCACAAGGTAACCACAAAGTTTTATTACAACGATTA 17160
L I L N E L T * L T G N T N * F L T A L
* Y L I K * H K Y H E M P T E F Y H Q *
T Y S K R T N I T N W Q H K L I I N S I

17161 ATAGTCGTGTAACCTTACTTTGCAATAACGTGACAAGTTCCAGGGGGACCATGCCCTTTC 17220
* * C M P I F R * Q V T * P G G P V P F
N D A C Q F S V N N C Q E L D G Q Y P F
I L V N S H F T I A S N L T G R T R S L

17221 AGAGTAGAACGATATCCAGATCGACAAATAATGATGTGTCGTGCACATCAAATATGACGA 17280
D * R A I P R A T * * * V A R T T * V A
T E D Q * L D L Q K N S C L V H L K Y Q
R M K S Y T * S N I V V C C T Y N I S S

FIG. 3 CONT'D

```
17281  CGATCAGTACGACGACATCTACGTAACACACTTTTTCGAATATTCAAAAATTTATAATTG  17340
        A  L  *  A  A  T  S  A  N  H  S  F  A  *  L  N  K  F  I  L
       Q  *  D  H  Q  Q  L  H  M  T  H  F  L  K  Y  T  K  L  Y  *
         S  T  M  S  S  Y  I  C  Q  T  F  F  S  I  L  K  *  I  N  V

17341  CTAACATGTGCATAATAAGGACGATTTCAAGCACATCTAACAATACTATTCAAATTTTAA  17400
        S  Q  V  R  I  I  G  A  L  T  R  T  S  Q  *  S  L  N  L  I
       R  N  Y  V  Y  *  E  Q  *  L  E  H  L  N  N  H  Y  T  *  F
         I  T  C  T  N  N  R  S  F  N  T  Y  I  T  I  I  L  K  F  N

17401  TTACTATGGTGAACATTCATACAAAAATGGTGTTATTTACGTAATGGTCTCAACCAATGT  17460
        L  S  V  V  Q  L  Y  T  K  V  V  I  F  A  N  G  S  N  T  V
       *  H  Y  W  K  Y  T  H  K  *  W  L  L  H  M  V  L  T  P  *
         I  I  G  S  T  L  I  N  K  G  C  Y  I  C  *  W  L  Q  N  C

17461  CTATAACAACAACAACTACTTCAATCATACGAATGATTAATACTTAACAGACAATATTTA  17520
        S  I  T  T  T  S  S  T  L  I  S  V  L  *  S  N  D  T  I  F
       L  Y  Q  Q  Q  Q  H  L  *  Y  A  *  *  N  H  I  T  Q  *  L
         I  N  N  N  N  I  F  N  T  H  K  S  I  I  F  Q  R  N  Y  I

17521  CGAGCATAATTTCGATTTGTAATACATATATAACCTCTAGGACGAGTTAATGGACGTGGT  17580
        A  R  I  L  A  L  C  *  T  Y  I  P  S  G  A  *  N  G  A  G
       H  E  Y  *  L  *  V  N  H  I  Y  Q  L  D  Q  E  I  V  Q  V
         S  T  N  F  S  F  M  I  Y  I  N  S  I  R  S  L  *  R  C  W

17581  GCACACGACAACTCGTTCCCAAGAAATCTTGGATCCGTGAAGTTAAGATAATGATTTTAT  17640
        R  T  S  N  L  L  P  E  K  S  G  L  C  K  L  E  I  V  L  I
       V  H  A  T  S  C  P  N  K  L  V  *  A  S  *  N  *  *  *  F
         T  H  Q  Q  A  L  T  R  *  F  R  P  V  E  I  R  N  S  F  Y

17641  TACACAACAAATCCAGGACTATAGAAAAACCCTTTAACAATATCCACAGGATTTCTTTAA  17700
        I  H  Q  K  P  G  S  I  K  K  P  F  Q  *  L  H  G  L  S  I
       L  T  N  N  L  D  Q  Y  R  K  P  F  N  N  Y  T  D  *  L  F
         H  T  T  *  T  R  I  D  K  Q  S  I  T  I  P  T  R  F  F  N

17701  CATCTTTGACAAAGTCGTAACCAAATACTATTATTTGAGTTCCGATTTTTACTATTATCA  17760
        T  S  V  T  E  A  N  T  *  S  L  L  S  L  A  L  F  S  L  L
       Q  L  F  Q  K  L  M  P  K  H  Y  Y  V  *  P  *  F  H  Y  Y
         Y  F  S  N  *  C  Q  N  I  I  I  F  E  L  S  F  I  I  I  T

17761  AGTAATACAAAATTTCATATAAAATTCCCTGTCTGTTGTGTACTCTCAAGTTCACGACAT  17820
        E  N  H  K  L  T  Y  K  L  P  C  V  V  C  S  L  E  L  A  T
       N  M  I  N  *  L  I  N  *  P  V  S  L  V  H  S  N  L  H  Q
         *  *  T  K  F  Y  I  K  L  S  L  C  C  M  L  T  *  T  S  Y
```

FIG. 3 CONT'D

17821 TTATAAGTTGTCTATATAGATTAATCATTTAAAAATTTTCGATTAGGTCAAACCTTATCA 17880
F I * C I Y R I L L N K F A L G T Q F L
L Y E V S I D L * Y I K L L * D L K S Y
I N L L Y I * N T F K * F S I W N P I T

17881 CGACAAAAATAATCAGGAATATTATCAGTCTTAATACAACGATTCGCACAAAATCCACAA 17940
A T K I L G * L L * F * T A L R T K P T
H Q K * * D K Y Y D S N H Q * A H K L H
S N K N T R I I T L I I N S L T N * T N

17941 GTTTGTGTTTGACATCTAAGACGAGTTCCAAGCCTTATACTAATACAATATATAAGTGTT 18000
* V C V T S E A * P E S Y S * T I Y E C
E F V F Q L N Q E L N P I H N H * I N V
L C L S Y I R S L T R F I I I N Y I * L

18001 TGTCGTCTTTGTCGGGTAAGACAATTACAATTAGCTAAATTACAACGGTATTGATCTCGG 18060
V A S V A W E T L T L R N L T A M V L A
F L L F L G N Q * H * D I * H Q W L * L
C C F C G M R N I N I S K I N G Y S S G

18061 TTCTTCCCGTAAAAAACACAATACTCATTATACGTTAATAAACTTAGAGAATTAAAATAA 18120
L F P M K Q T I L L I C N N S D R L K I
W S P C K K H * S Y Y A I I Q I E * N *
L L A N K T N H T I H L * K F R K I K N

18121 TGAGATGGAAATCTATTTTAAGTTTTAGTTTGAAATGGAGCAAACGTAACGTGTTGATTA 18180
V R G K S L I * F * V K G R K C Q V V L
* E V K L Y F E F D F K V E N A N C L *
S * R * I F N L I L S * R T Q M A C S I

18181 GAAAAATTTCTAACATCATTTTCAACGAATCCAATAGTAGGTCGCGTACGGGGGAGTAAA 18240
R K L S Q L L L Q K P * * G A C A G E N
D K * L N Y Y F N S L N D D L A H G R M
K K F I T T F T A * T I M W R M G G * K

18241 AATCGTCAACTACTATTTATATTCCAATTACTTTTAAACCGACATTTAAATTTATAAACA 18300
K A T S S L Y L T L S F K A T F K F I Q
K L L Q H Y I Y P * H F N P Q L N L Y K
* C N I I F I L N I F I Q S Y I * I N T

18301 CTTGGACAAAATTGTATAAGAGCAAATTATAGAGAATACCCAAAATTTAATCTAAACTGA 18360
S G T K V Y E R K I D R I P K L N S K V
H V Q K L M N E N L I E * P N * I L N S
F R N * C I R T * Y R K H T K F * I Q S

FIG. 3 CONT'D

```
18361  GAACTACCAATAAGATTTAACAAATAATGATTTCTACTTCGGTAATTTGCACAATCTCCA  18420
        R  S  P  *  E  L  N  N  I  V  L  S  S  A  M  L  R  T  L  P
       E  Q  H  N  N  *  I  T  *  *  *  L  H  L  W  *  V  H  *  L
         K  I  T  I  R  F  Q  K  N  S  F  I  F  G  N  F  T  N  S  T

18421  ACCCAACCAAAACTACAACTCCCGCGAGTACGATGAGCGCTTTTGTAACCTTGTTTGAAA  18480
        Q  T  P  K  S  T  S  P  A  *  A  V  R  S  F  M  P  V  F  K
       N  P  Q  N  Q  H  Q  P  R  E  H  *  E  R  F  C  Q  F  L  S
         P  N  T  K  I  N  L  A  S  M  S  S  A  F  V  N  S  C  V  K

18481  GGTGACGTTTATCCAAAAAGTTGACCACACCTAAAACATCAACTTCGATGACCGAATAAA  18540
        G  S  C  I  P  K  E  V  P  T  S  K  T  T  S  A  V  P  K  N
       E  V  A  F  L  N  K  L  Q  H  P  N  Q  L  Q  L  *  Q  S  I
         W  Q  L  Y  T  K  *  S  T  H  I  K  Y  N  F  S  S  A  *  K

18541  CGACTCTCTCTAACAATATGAAAATTTTTTTGACATCGATTTCGAGGAGGACCACTTTTT  18600
        A  S  L  S  Q  *  V  K  L  F  V  T  A  L  A  G  G  P  S  F
       Q  Q  S  L  N  N  Y  K  *  F  F  Q  L  *  L  E  E  Q  H  F
         S  L  S  I  T  I  S  K  F  F  S  Y  S  F  S  R  R  T  F  F

18601  AAATTTGTAAATTATGGGGAATACAGTTTTCCAGTTTTCACCCTATAACAATCTTAATCT  18660
        N  L  C  K  I  G  R  I  D  F  P  *  F  H  S  I  T  L  I  L
       I  *  V  N  L  V  G  *  T  L  L  D  F  T  P  Y  Q  *  F  *
         K  F  M  *  Y  G  K  H  *  F  T  L  L  P  I  N  N  S  N  S

18661  TAACAAGTTTACAATAGACTAATAGAAAATCTGGAAAGACTATCACATCATAAATAATGA  18720
        I  T  *  I  N  D  S  *  R  K  S  R  E  S  L  T  T  N  I  V
       F  Q  E  F  T  I  Q  N  D  K  L  G  K  Q  Y  H  L  I  *  *
         N  N  L  H  *  R  I  I  K  *  V  K  R  I  T  Y  Y  K  N  S

18721  ACCAGACGGTCAAAACTTGAATGAACAAATTCCATAAAACGATTTAATCCGTCTCTCGAA  18780
        Q  D  A  L  K  S  S  V  Q  K  L  Y  K  A  L  N  P  L  S  S
       K  T  Q  W  N  Q  V  *  K  N  L  T  N  Q  *  I  L  C  L  A
         P  R  G  T  K  F  K  S  T  *  P  I  K  S  F  *  A  S  L  K

18781  TTAACATTACACACAAGATTAGCACGATGTACGATGTTAAGATCTTGACCAATAATACCA  18840
        L  Q  L  T  H  E  L  R  A  V  H  *  L  E  L  V  P  *  *  P
       *  N  Y  H  T  N  *  D  H  *  M  S  C  N  *  F  Q  N  N  H
         I  T  I  H  T  R  I  T  S  C  A  V  I  R  S  S  T  I  I  T

18841  ACAACCGCGGTATCAATATGAACACTAATACACATATTAGGTGAATAACATCTATATGTT  18900
        Q  Q  R  W  L  *  V  Q  S  *  T  Y  L  G  S  I  T  S  I  C
       N  N  A  G  Y  N  Y  K  H  N  H  T  Y  D  V  *  Q  L  Y  V
         T  P  A  M  T  I  S  T  I  I  H  I  I  W  K  N  Y  I  Y  L
```

FIG. 3 CONT'D

18901 GTCACCCCAATATGTCCAAGAAATTGATCATTAGTGCTATATTAAACATTACATGTATTT 18960
C H P * V P E K V L L * S I I Q L T C L
V T P N Y L N K L * Y D R Y L K Y H V Y
L P T I C T R * S T I V I Y N T I Y M F

18961 CCACGTGTACAACGCAGTCGACTACGTTAATACTGAGCAACAAATCGTTAGATACTAACA 19020
P A C T A D A S A I I V R Q K A I * S Q
L H V H Q T L Q H L * S E N N L L R H N
T C M N R * S I C N H S T T * C D I I T

19021 AAAACATTTAGACAATTAACCTTAAATCTCATAGGTTATTAAAGATTACTCCAGTCATAT 19080
K Q L D T L Q F K S Y G I I E L S T L I
N K Y I Q * N S N L T D L L K * H P * Y
K T F R N I P I * L I W Y N R I L D T Y

19081 TTATGTAGAACATCCAATAACGTCGCACAGTACGAATTTCGACGGTACGATACATTATCT 19140
F V D Q L N N C R T M S L A A M S H L L
L Y M K Y T I A A H * A * L Q W A I Y Y
I C R T P * Q L T D H K F S G H * T I S

19141 ATGTTGAATACAATACTGTATCCGTTAGGATTTCCAAATCGAACACAGTTTCTAATACTT 19200
Y L K H * S M P L G L P K A Q T L S * S
I C S I N H C L C D * L N L K H * L N H
V V * T I V Y A I R F T * S T D F I I F

19201 AAATTTAAAATACTACGAAAAGGACATCGGTTCAGACAATTTGTCAATAAAATACAGATA 19260
N L N * S A K G T A L D T L C N N * T *
I * I K H H K E Q L W T Q * V T I K H R
K F K I I S K R Y G L R N F L * K I D I

19261 CTACACGTATTTCTATTAAAATTTCTACCAAATACATACAAAACCTTAACATTACAACTA 19320
S T C L S L K L S P K H I N Q F Q L T S
H H A Y L Y N * L H N I Y T K S N Y H Q
I H M F I I K F I T * T H K P I T I N I

19321 TTTATAGGTAGATTAAGTTAACAAACATCTAAACTGTGAGCTCACAATTTATTTAATTTG 19380
L Y G D L E I T Q L N S V R T N F L N F
Y I D M * N L Q K Y I Q C E L T L Y I L
F I W R I * N N T S K V S S H * I F * V

19381 GAAGGACCTACATTACCACCATCAAACATACAATTATTTGTACGTAAGGTATGATTAGGA 19440
R G P H L P P L K Y T L L C A N W V L G
G E Q I Y H H Y N T H * Y V H M G Y * D
K R S T I T T T Q I N I F M C E M S I R

FIG. 3 CONT'D

```
19441  AAATGATCTTGACAAAAACTTTTAGAATTCGGATACGGAAAAAAGATAATAAGTCTATGC  19500
        K  V  L  V  T  K  S  F  R  L  G  I  G  K  K  *  *  E  S  V
       K  *  *  F  Q  K  Q  F  D  *  A  *  A  K  K  R  N  N  L  Y
         K  S  S  S  N  K  F  I  K  L  R  H  R  K  E  I  I  *  I  R

19501  GGAACACACATGCATCTACCAAATCTTAGATTTGTTCAACTAATGCAAGGAAATTCTTCG  19560
        G  Q  T  Y  T  S  P  K  S  D  L  C  T  S  *  T  G  K  L  L
       A  K  H  T  R  L  H  N  L  I  *  V  L  Q  N  R  E  K  L  F
         R  T  H  V  Y  I  T  *  F  R  F  L  N  I  V  N  R  *  S  A

19561  CGGTGAACATAGTGTGCCACATTAGATCCACCTCGACAAACAAGTTTCGTACGACTTCTT  19620
        A  V  Q  I  V  R  H  L  R  P  P  A  T  Q  E  F  C  A  S  S
       R  W  K  Y  *  V  T  Y  D  L  H  L  Q  K  N  L  A  H  Q  L
         G  S  T  D  C  P  T  I  *  T  S  S  N  T  *  L  M  S  F  F

19621  ATAACATTGATGGAACTCAGAATATTATATCAATGATGTCGTCCGAAATGAAAAACCCAA  19680
        Y  Q  L  *  R  S  D  *  L  I  T  V  V  A  P  K  V  K  Q  T
       I  N  Y  S  G  Q  T  K  Y  Y  L  *  *  L  L  S  *  K  K  P
         I  T  V  V  K  L  R  I  I  Y  N  S  C  C  A  K  S  K  P  N

19681  ATATTCTTAAAACTAAAAATATTAAATACCTTGTGAAAATGATGCAATGTCTCAAATCTT  19740
        *  L  F  K  S  K  *  L  K  H  F  V  K  V  V  N  C  L  K  S
       K  Y  S  N  Q  N  K  Y  N  I  S  C  K  *  *  T  V  S  N  L
         I  L  I  K  I  K  I  I  *  P  V  S  K  S  R  *  L  T  *  F

19741  TTGCATTATATATTGAACCAATTACAACCAGTAATACTACCTGCATGTCCACTTAATGGA  19800
        F  T  I  Y  L  K  T  L  T  P  *  *  S  P  R  V  P  S  N  G
       F  R  L  I  Y  S  P  *  H  Q  D  N  H  H  V  Y  L  H  I  V
         V  Y  Y  I  V  Q  N  I  N  T  M  I  I  S  T  C  T  F  *  R

19801  ACACGATAATACTTACTGTTTCAACAACAATTCTAATTATTACATCTATGACAATAAAAA  19860
        Q  A  I  I  F  S  L  T  T  T  L  I  L  L  T  S  V  T  I  K
       K  H  *  *  S  H  C  L  Q  Q  *  S  *  Y  H  L  Y  Q  *  K
         T  S  N  H  I  V  F  N  N  N  L  N  I  I  Y  I  S  N  N  K

19861  TTTTTATTATGTAGTAAAGGATGATTATATCGACAACTTAACAAATGTTTTGCATCATAG  19920
        L  F  L  V  D  N  G  V  L  I  A  T  S  N  N  V  F  R  L  I
       *  F  Y  Y  M  M  E  *  *  Y  L  Q  Q  I  T  *  L  V  Y  Y
         F  I  I  C  *  K  R  S  I  Y  S  N  F  Q  K  C  F  T  T  D

19921  GCCGTGGTGGGACTTGAATTCTAAGAATCTTTAAACTTGTAACTATAAACAACCTTCGTA  19980
        R  C  W  G  S  S  L  I  R  L  F  K  F  M  S  I  Q  Q  F  C
       G  A  G  G  Q  V  *  S  E  *  F  N  S  C  Q  Y  K  N  S  A
         P  V  V  R  F  K  L  N  K  S  I  Q  V  N  I  N  T  P  L  M
```

FIG. 3 CONT'D

```
19981 CAGGACACCCTAATACAATTTCTATCAAACAAAACATCAAGGTGAATACCACAAACATTT 20040
       T  R  H  S  *  T  L  S  L  K  N  Q  L  E  V  *  P  T  Q  L
      H  G  T  P  N  H  *  L  Y  N  T  K  Y  N  W  K  H  H  K  Y
        D  Q  P  I  I  N  F  I  T  Q  K  T  T  G  S  I  T  N  T  F

20041 ATGTGTCTAAACTTCAAGTAGCTTTTAAACTTATATGAAAAACTACCAGCACTGTGACCG 20100
       Y  V  S  K  F  N  M  S  F  K  F  I  S  K  S  P  R  S  V  P
      I  C  L  N  S  T  *  R  F  N  S  Y  V  K  Q  H  D  H  C  Q
        V  C  I  Q  L  E  D  F  I  Q  I  Y  K  K  I  T  T  V  S  A

20101 CGAAATCTTCGAAAATCTTTTCGTTCTTTACCACAAAAATAATCATGACTTTTTAATTCA 20160
       A  K  S  A  K  L  F  A  L  F  P  T  K  I  L  V  S  F  N  L
      R  K  L  L  K  *  F  L  L  F  H  H  K  *  *  Y  Q  F  I  L
        S  *  F  S  K  S  F  C  S  I  T  N  K  N  T  S  F  F  *  T

20161 TCCAATAGTTACTAATTTCCAGGCGTTGCTCGACTAAATTTACCACACTAACACCTATTT 20220
       L  N  D  I  I  L  P  G  C  R  A  S  K  F  P  T  I  T  S  L
      Y  T  I  L  S  *  L  D  A  V  L  Q  N  L  H  H  S  Q  P  Y
        P  *  *  H  N  F  T  R  L  S  S  I  *  I  T  H  N  H  I  F

20221 CAACCTCTTGAGTTTCAACTCAAAACCAAGCGATACTCTTTTCTACCACTGCTACAATAG 20280
       T  P  S  S  L  T  S  N  Q  N  A  I  L  F  S  P  S  S  T  I
      L  Q  L  V  *  L  Q  T  K  T  R  *  S  F  L  H  H  R  H  *
        N  S  F  E  F  N  L  K  P  E  S  H  S  F  I  T  V  I  N  D

20281 AAGTCGGCTTGTCTGTCGGATACGAGTTCGGTAATGACCTCGGGTGTTCCATTAGATCCA 20340
       K  L  R  V  S  L  R  H  E  L  W  *  Q  L  G  C  P  L  R  P
      R  *  G  F  L  C  G  I  S  L  G  N  S  S  G  V  L  Y  D  L
        E  A  S  C  V  A  *  A  *  A  M  V  P  A  W  L  T  I  *  T

20341 CCATTAACGCGCCCATTACAGTAACCATTACTACGAGATTGTGCAAAATGATAGAAATGA 20400
       P  L  Q  A  P  L  T  M  P  L  S  A  R  V  R  K  V  I  K  V
      H  Y  N  R  P  Y  H  *  Q  Y  H  H  E  L  V  N  *  *  R  *
        T  I  A  R  T  I  D  N  T  I  I  S  *  C  T  K  S  D  K  S

20401 GTCTCAGCACATAACAGTTCAAAACTTGGAGCGAGTCTAAATCTTGCCCTAAAATAACTA 20460
       *  L  R  T  N  D  L  K  S  G  R  E  S  K  S  R  S  K  I  S
      E  S  D  H  I  T  L  N  Q  V  E  S  L  N  L  V  P  N  *  Q
        L  T  T  Y  Q  *  T  K  F  R  A  *  I  *  F  P  I  K  N  I

20461 TACCTACTATTAGACAAATAACGATTTATACCAAATCTTCTGATACGTAAACTAGTATAT 20520
       I  S  S  L  R  N  I  A  L  Y  P  K  S  S  *  A  N  S  *  I
      Y  P  H  Y  D  T  *  Q  *  I  H  N  L  L  S  H  M  Q  D  Y
        H  I  I  I  Q  K  N  S  F  I  T  *  F  V  I  C  K  I  M  Y
```

FIG. 3 CONT'D

```
20521 CAAATACCATCAAAATTGGTATTTCAATATCCTCCAAACGTAAACGAATATCCGAATAAA 20580
       T  *  P  L  K  L  W  L  T  I  P  P  K  C  K  S  I  P  K  N
      L  K  H  Y  N  *  G  Y  L  *  L  L  N  A  N  A  *  L  S  I
        N  I  T  T  K  V  M  F  N  Y  S  T  Q  M  Q  K  Y  A  *  K

20581 GCATCCTTTTTTTTTAGATTAAACAATTAAGTTCTCAAAAATGTCATACTAAGATCATAA 20640
       R  L  F  F  F  D  L  K  N  I  *  S  N  K  C  Y  S  E  L  I
      E  Y  S  F  F  I  *  N  T  L  E  L  T  K  V  T  H  N  *  Y
        T  P  F  F  F  R  I  Q  *  N  L  L  K  *  L  I  I  R  T  N

20641 GTAAGTATAAAATAATGACTAGTCCTCACACCATCATCATTCTCACAAACATGTCAATAA 20700
       *  E  Y  K  I  V  S  *  S  H  P  L  L  L  L  T  Q  V  T  I
      E  N  M  N  *  *  Q  D  P  T  H  Y  Y  Y  S  H  K  Y  L  *
        M  *  I  K  N  S  I  L  L  T  T  T  T  L  T  N  T  C  N  N

20701 CTAAATAATAATCTACTAAAACAAAGATAACAATTCAGTAATTTAAACTCAACACAATCA 20760
       S  K  N  N  S  S  K  T  E  I  T  L  D  N  F  K  L  Q  T  L
      Q  N  I  I  L  H  N  Q  K  *  Q  *  T  M  L  N  S  N  H  *
        I  *  *  *  I  I  K  N  R  N  N  L  *  *  I  Q  T  T  N  T

20761 TTTCAACAATTATAATTACAACTAAAATTCCTAAAAGTTAAATACAACACCACATTACTA 20820
       L  T  T  L  I  L  T  S  K  L  S  K  *  N  I  N  H  H  L  S
      Y  L  Q  *  Y  *  H  Q  N  *  P  N  E  I  *  T  T  T  Y  H
        F  N  N  I  N  I  N  I  K  L  I  K  L  K  H  Q  P  T  I  I

20821 TTATTTTAATACTGAAAAATAGGATTTTACGTTCGGTGATTACTAACCTTTGGACCGATA 20880
       L  L  I  I  V  K  *  G  L  I  C  A  V  L  S  Q  F  G  P  *
      Y  Y  F  *  S  K  K  D  *  F  A  L  W  *  H  N  S  V  Q  S
        I  F  N  H  S  K  I  R  F  H  L  G  S  I  I  P  F  R  A  I

20881 AGATACGGACAAAACATATTCATAAACTTACAAGGTAATCTCTCTCAGAGAAATACCTTA 20940
       E  I  G  T  K  Y  L  Y  K  F  T  G  N  S  L  T  E  K  H  F
      N  *  A  Q  K  T  Y  T  N  S  H  E  M  L  S  L  R  K  I  S
        R  H  R  N  Q  I  L  I  Q  I  N  W  *  L  S  D  R  *  P  I

20941 ATACCATTTGGATAATTAAACGGATGTCCGACATACTACTTACAACGATTCATGTGAGTT 21000
       *  P  L  G  I  L  K  G  V  P  Q  I  I  F  T  A  L  Y  V  *
      N  H  Y  V  *  *  N  A  *  L  S  Y  S  S  H  Q  *  T  C  E
        I  T  F  R  N  I  Q  R  C  A  T  H  H  I  N  S  L  V  S  L

21001 AATACAGTCATAAACTTATGATGTTGTAATCGACAAGGACAATTATACGCACAAAATGTA 21060
       N  H  *  Y  K  F  V  V  V  N  A  T  G  T  L  I  R  T  K  C
      I  I  D  T  N  S  Y  *  L  M  L  Q  E  Q  *  Y  A  H  K  V
        *  T  L  I  Q  I  S  C  C  *  S  N  R  N  I  H  T  N  *  M
```

FIG. 3 CONT'D

```
21061 AATCCACGTCCCAGACTATTTCTTCATCGAGGTCCAAGACGACAAAATTCTGTCACCAAT 21120
       K  P  A  P  D  S  L  S  T  A  G  P  E  A  T  K  L  C  H  N
      N  L  H  L  T  Q  Y  L  L  L  E  L  N  Q  Q  K  L  V  T  T
        *  T  C  P  R  I  F  F  Y  S  W  T  R  S  N  *  S  L  P  *

21121 GGTAGACCATCATAAGAACATCTATTACTAAATTTGGGTAAACAATCGCTATCAAATCAA 21180
       G  D  P  L  I  R  T  S  L  S  K  F  G  N  T  L  S  L  K  T
      V  M  Q  Y  Y  E  Q  L  Y  H  N  L  G  M  Q  *  R  Y  N  L
        W  R  T  T  N  K  Y  I  I  I  *  V  W  K  N  A  I  T  *  N

21181 TGAATAAAACCTCTAACATACTGAAATGGTAAACTAACAGTAACCCTAAACTATTATAGA 21240
       V  *  K  P  S  Q  I  V  K  G  N  S  Q  *  Q  S  K  I  I  D
      *  K  N  Q  L  N  Y  S  K  V  M  Q  N  D  N  P  N  S  L  I
        S  I  K  S  I  T  H  S  *  W  K  I  T  M  P  I  Q  Y  Y  R

21241 CTATACATACTAGGAGAATGATTTTTATAACCACTAATATTACACTCATTCCTACCCAAA 21300
       S  I  Y  S  G  R  V  L  F  I  P  S  *  L  T  L  L  S  P  N
      Q  Y  T  H  D  E  *  *  F  Y  Q  H  N  Y  H  S  Y  P  H  T
        I  H  I  I  R  K  S  F  I  N  T  I  I  I  H  T  L  I  P  K

21301 AAATGAATGTAAACAGTAAATTAAGCACTATTTAATAGAAACCCACCATCACATCGATAT 21360
       K  V  *  M  Q  *  K  I  R  S  L  N  D  K  P  P  L  T  A  I
      K  *  K  C  K  D  N  L  E  H  Y  I  I  K  P  H  Y  H  L  *
        K  S  V  N  T  M  *  N  T  I  F  *  R  Q  T  T  T  Y  S  Y

21361 TTTTAATGTCTCAAAAGAACCTTACGACTAAATATATTTAATTACTCAACAAAACGTAAA 21420
       F  I  V  S  N  E  Q  F  A  S  K  Y  L  N  I  L  Q  K  A  N
      L  F  *  L  T  K  K  S  H  Q  N  I  Y  I  L  S  N  N  Q  M
        F  N  C  L  K  R  P  I  S  I  *  I  F  *  H  T  T  K  C  K

21421 ACCTGTCAAAAAACATGATTACATTTACGAAGAAGATCACTTCCCAAAAATTATCCATAT 21480
       Q  V  T  K  Q  V  L  T  F  A  E  E  L  S  P  N  K  I  P  I
      K  S  L  K  K  Y  *  H  L  H  K  K  *  H  L  T  K  L  L  Y
        P  C  N  K  T  S  I  Y  I  S  R  R  T  F  P  K  *  Y  T  Y

21481 TTAATGGACCCATTTAGAAGAAAACTTTATCTACCGTTACAATACGTACGATTGATAAAC 21540
       F  *  R  P  L  D  E  K  S  I  S  P  L  T  I  C  A  L  *  K
      L  N  G  P  Y  I  K  K  Q  F  L  H  C  H  *  A  H  *  S  N
        I  V  Q  T  F  R  R  K  F  Y  I  A  I  N  H  M  S  V  I  Q

21541 AAAACCTCTTTATCATGTTGTACCTTACCGCCACGAATATCAAATAAACTATACTGATTT 21600
       N  Q  L  F  L  V  V  H  F  P  P  A  *  L  K  N  S  I  V  L
      T  K  S  F  Y  Y  L  M  S  H  R  H  K  Y  N  I  Q  Y  S  *
        K  P  S  I  T  C  C  P  I  A  T  S  I  T  *  K  I  H  S  F
```

FIG. 3 CONT'D

```
21601  AAAAGAAACTTTAACCGACCGTGACGACAACAATTAAATTCTGGTCTAGTTAATTTACTA  21660
        N  E  K  F  N  A  P  V  A  T  T  L  K  L  G  S  *  N  F  S
       I  K  K  S  I  P  Q  C  Q  Q  Q  *  N  L  V  L  D  I  L  H
         K  R  Q  F  Q  S  A  S  S  N  N  I  *  S  W  I  L  *  I  I

21661  AATCAAATAAGAGAATAACTTTCTCCATTTAATAATCAAGCGCTATGCGCATTTCTCTAA  21720
        K  T  *  E  R  I  S  L  P  L  N  N  T  R  S  V  R  L  S  I
       N  L  K  N  E  *  Q  F  L  Y  I  I  L  E  R  Y  A  Y  L  S
         *  N  I  R  K  N  F  S  T  F  *  *  N  A  I  R  T  F  L  N

21721  AAACAACCACTATCAGAACATTTATGAACAATCTAGAGTAATTTAGATTTGATACAATTA  21780
        K  T  P  S  L  R  T  F  V  Q  *  I  E  N  F  R  F  *  T  L
       K  Q  Q  H  Y  D  Q  L  Y  K  N  S  R  M  L  D  L  S  H  *
         K  N  T  I  T  K  Y  I  S  T  L  D  *  *  I  *  V  I  N  I

21781  ATAAAAAAATAAAAAAATAAAGACAATACCAAAATTACTTGGAGAATTACAACACAGAGT  21840
        *  K  K  I  K  K  N  R  N  H  N  *  H  V  E  *  H  Q  T  E
       N  N  K  *  K  K  I  E  T  I  T  K  I  F  R  K  I  N  H  R
         I  K  K  N  K  *  K  Q  *  P  K  L  S  G  R  L  T  T  D  *

21841  AAATTTGGTACTGACCAAAAATAAACCACTATCAGCAAGACTAACATTGGTATAATTATT  21900
        N  L  G  H  S  T  K  I  Q  H  Y  D  N  Q  N  Y  G  Y  *  Y
       M  *  V  M  V  P  K  *  K  T  I  T  T  R  I  T  V  M  N  I
         K  F  W  S  Q  N  K  N  P  S  L  R  E  S  Q  L  W  I  L  L

21901  AAATTTTTAATTTTTAAAACTAATAAACCTATAAGTGGGATCAAACACGTTGTTACCATT  21960
        N  L  F  *  F  N  Q  N  N  P  Y  E  G  *  N  T  C  C  H  Y
       I  *  F  N  F  I  K  I  I  Q  I  N  V  R  T  Q  A  V  I  T
         K  F  I  L  F  K  S  *  K  S  I  *  G  L  K  H  L  L  P  L

21961  CTAAAGTAGATCACGGCCACTAAGATAAAAATTCTCAAAAGTAAAGTGAGCTAAAATATT  22020
        S  K  M  *  H  R  H  N  *  K  *  S  N  E  N  *  E  I  K  Y
       L  N  *  R  T  G  T  I  R  N  K  L  T  K  M  E  S  S  K  I
         I  E  D  L  A  P  S  E  I  K  L  L  K  *  K  V  R  N  *  L

22021  AATGTGACCGCTTCCACTAGTTTAATAAAAAATACTCCCACAATTAAAATTAGGAATAGT  22080
        N  C  Q  R  L  H  D  F  *  K  K  H  P  H  *  N  *  D  K  D
       I  V  S  A  F  T  I  L  N  N  K  I  L  T  N  I  K  I  R  I
         *  V  P  S  P  S  *  I  I  K  *  S  P  T  L  K  L  G  *  *

22081  ATCTAAATTCACAAAAGGATTACCATCATTACTACATACCGAAGAATTGTTCCATTCTAA  22140
        Y  I  *  T  N  E  *  H  Y  Y  H  H  I  A  E  *  C  P  L  I
       M  S  K  L  T  K  R  I  T  T  I  I  Y  P  K  K  V  L  Y  S
         L  N  L  H  K  G  L  P  L  L  S  T  H  S  R  L  L  T  L  N
```

FIG. 3 CONT'D

```
22141  AATAGCACGGAATATAAGATTATACCGGAAAAAAGCAATAGAATGAAAACAACTATAAGG  22200
        K  D  H  R  I  N  *  Y  P  R  K  E  N  D  *  K  Q  Q  Y  E
       K  I  T  G  *  I  R  I  H  G  K  K  T  I  K  S  K  N  I  N
         *  R  A  K  Y  E  L  I  A  K  K  R  *  R  V  K  T  S  I  G

22201  AATATTACAAAGAGAAAGATTCAAATTAAGAACATTTTCACTATAAAATAGTGAATTGTT  22260
        K  Y  H  K  E  K  *  T  *  N  K  Y  F  H  Y  K  I  V  *  C
       R  I  I  N  R  K  R  L  K  I  R  T  F  T  I  N  *  *  K  V
         *  L  T  E  R  E  L  N  L  E  Q  L  L  S  I  K  D  S  L  L

22261  AGGATAAAAATAATTAATAAGATTCCTTCAAATAAAATGAAATAATCCAACAAGAGAAAT  22320
        D  *  K  *  *  N  N  *  P  L  K  N  *  K  I  L  N  N  E  K
       I  R  N  K  N  I  I  R  L  F  N  I  K  S  *  *  T  T  R  K
         G  I  K  I  L  *  E  L  S  T  *  K  V  K  N  P  Q  E  R  *

22321  AAATCATGGCGAAACGGAAAAATTTAGATTGAAATCAGTCATGATAATATTGTATCTATG  22380
        N  L  V  A  K  G  K  *  I  *  S  *  D  T  S  N  Y  C  L  Y
       I  *  Y  R  K  A  K  K  F  R  V  K  T  L  V  I  I  V  Y  I
         K  T  G  S  Q  R  K  L  D  L  K  L  *  Y  *  *  L  M  S  V

22381  ACCGAGACAAATACCAAAAAGATTACAACAAATAGGACTAAATCTGACATAAATATAAAG  22440
        Q  S  Q  K  H  N  K  *  H  Q  K  D  Q  N  L  S  Y  K  Y  K
       S  A  R  N  I  T  K  R  I  N  N  I  R  I  *  V  T  N  I  N
         P  E  T  *  P  K  E  L  T  T  *  G  S  K  S  Q  I  *  I  E

22441  AGAATTTGGTCCAAGAATATTTCAAAGGTGGTGACGTGGAAAAAATAGGAATGGATGATT  22500
        E  *  V  L  N  K  Y  L  K  W  W  Q  V  K  K  I  R  V  *  *
       R  K  F  W  T  R  I  F  N  G  G  S  C  R  K  *  G  *  R  S
         R  L  G  P  E  *  L  T  E  V  V  A  G  K  K  D  K  G  V  L

22501  TCGAGAGACAAAACTATTTAGATTTGTTAAACATGGACATGTCCAACAACTAAGATCTAC  22560
        L  E  R  N  Q  Y  I  *  V  I  Q  V  Q  V  P  Q  Q  N  *  I
       F  S  E  T  K  I  F  R  F  L  K  Y  R  Y  L  N  N  I  R  S
         A  R  Q  K  S  L  D  L  C  N  T  G  T  C  T  T  S  E  L  H

22561  CTTGTTGCTCGCACGGAGTCTATAAAGAAATAGACAACGTACAGTTAACGGTATAACAAT  22620
        S  C  R  A  H  R  L  Y  K  K  I  Q  Q  M  D  I  A  M  N  N
       P  V  V  L  T  G  *  I  N  R  *  R  N  C  T  L  Q  W  I  T
         F  L  S  R  A  E  S  I  E  K  D  T  A  H  *  N  G  Y  Q  *

22621  AAAAGCGTTAAGAAGACGATTAATACAACCGTTCATACTATAATTGGTGCCACTATCACC  22680
        N  E  C  N  K  Q  *  N  H  Q  C  T  H  Y  *  G  R  H  Y  H
       I  K  A  I  R  R  S  I  I  N  A  L  I  I  N  V  V  T  I  T
         K  R  L  E  E  A  L  *  T  P  L  Y  S  I  L  W  P  S  L  P
```

FIG. 3 CONT'D

```
22681 AAAATAAAGATAAAATAGACCAGAAAATATATTACAAAGAACATAAAGTATAATACCACA 22740
       N  *  K  *  K  I  Q  D  K  I  Y  H  K  K  Y  K  M  N  H  H
      T  K  N  R  N  *  R  T  K  *  I  I  N  R  T  N  *  I  I  T
        K  I  E  I  K  D  P  R  K  Y  L  T  E  Q  I  E  Y  *  P  T

22741 TAAAAATATACTATTAAAATGTAGGTAAACCGGGATAATAAGAAAACCATCCACAGGATG 22800
       I  K  I  H  Y  N  *  M  W  K  A  R  N  N  K  Q  Y  T  D  *
      Y  K  *  I  I  I  K  C  G  N  P  G  I  I  R  K  T  P  T  R
        N  K  Y  S  L  K  V  D  M  Q  G  *  *  E  K  P  L  H  G  V

22801 TAGAAGATAATAATTTGTAGGTTAAACACAAATACTAAAAAACGGATAATAAAATGTTCC 22860
       M  K  *  *  *  V  D  L  K  H  K  H  N  K  A  *  *  K  V  L
      C  R  R  N  N  F  M  W  N  T  N  I  I  K  Q  R  N  N  *  L
        D  E  I  I  L  C  G  I  Q  T  *  S  K  K  G  I  I  K  C  P

22861 ATAAAATAATACAAATCGAAATGAAAAACAACAAAAAGATAATAAAAACAATATATTGCT 22920
       Y  K  I  I  N  L  K  V  K  Q  Q  K  E  I  I  K  T  I  Y  R
      T  N  *  *  T  *  S  *  K  K  N  N  K  *  *  K  Q  *  I  V
        I  K  N  H  K  A  K  S  K  T  T  K  R  N  N  K  N  Y  L  S

22921 ATTTAGAGTAATTTAGATTTGTACAATAATTAATAAAAATAAAACGGATGTTGTAATCGA 22980
       Y  I  E  N  F  R  F  M  N  N  I  I  K  I  K  G  V  V  N  A
      I  F  R  M  L  D  L  C  T  I  L  *  K  *  K  A  *  L  M  L
        L  D  *  *  I  *  V  H  *  *  N  N  K  N  Q  R  C  C  *  S

22981 CAATATCCACTAAAATTAACATGATTAAAACGATAATTACTAAATTTGTGGTGTCAAGGA 23040
       T  I  P  S  K  L  Q  V  L  K  A  I  L  S  K  F  V  V  T  G
      Q  *  L  H  N  *  N  Y  *  N  Q  *  *  H  N  L  C  W  L  E
        N  Y  T  I  K  I  T  S  I  K  S  N  I  I  *  V  G  C  N  R

23041 GCGTATTCACTCATACAACACCTACAAAGAATACCAAACCCATGTATAATATATGAACTA 23100
       R  M  L  S  Y  T  T  S  T  E  *  P  K  P  V  Y  *  I  S  S
      E  C  L  H  T  H  Q  P  H  K  K  H  N  P  Y  M  N  Y  V  Q
        A  Y  T  L  I  N  H  I  N  R  I  T  Q  T  C  I  I  Y  K  I

23101 GCACAAATAAATTTATGATGATATAATAAATGACCAATAAAGGGATTTAGACCACGGTTA 23160
       R  T  *  K  F  V  V  I  N  N  V  P  *  K  G  L  D  P  A  L
      D  H  K  N  L  Y  *  *  I  I  *  Q  N  N  G  *  I  Q  H  W
        T  N  I  *  I  S  S  Y  *  K  S  T  I  E  R  F  R  T  G  I

23161 AAATCCCTAGATAGAAATTTTCCATGATGTATAAACTCATGAGAAACCATAGTCTTTGGG 23220
       K  L  S  R  D  K  F  P  V  V  Y  K  L  V  R  Q  Y  *  F  G
      N  *  P  D  I  K  L  L  Y  *  M  N  S  Y  E  K  T  D  S  V
        K  P  I  *  R  *  F  T  S  C  I  Q  T  S  K  P  I  L  F  G
```

FIG. 3 CONT'D

23221 AAAAATAGACTAAAATTATTACCATAAAAAAGATCTCAATTCTTATGATTCAACATACAA 23280
K K D S K L L P I K E L T L F V L N Y T
R K I Q N * Y H Y K K * L * S Y * T T H
K * R I K I I T N K R S N L I S L Q I N

23281 TTATTTTGAAACATATCACTCAAATCATGATATCAATATCCATCACAAAAATAATTGTTG 23340
L L V K Y L S N L V I T I P L T K I L L
* Y F K T Y H T * Y * L * L Y H K * * C
I F S Q I T L K T S Y N Y T T N K N V V

23341 AGAATATGATAACAACAAGTTGGAGTATTACCACAAAACCTCTAATGTCGAACAGTTATG 23400
E * V I T T * G * L P T K S I V A Q * Y
S K Y * Q Q E V E Y H H K P S * L K D I
R I S N N N L R M I T N Q L N C S T L V

23401 TGATACACACTCATAGGAGTATGATAAACATTTAGATTTCCATCAAGAGCATTACTTAGA 23460
V I H S Y G * V I Q L D L P L E R L S D
C * T H T D E Y * K Y I * L Y N E Y H I
S H T L I R M S N T F R F T T R T I F R

23461 ACCGTAAAACTATTTAGACTTGGAAACACAGACAAGTTCTTTTTAAAATGAATATTACAA 23520
Q C K S L D S G K H R N L F F K V * L T
K A N Q Y I Q V K T D T * S F N * K Y H
P M K I F R F R Q T Q E L F I K S I I N

23521 AGATGTCTAACCAACATAAAAGTAAAAATAGTTCTTGCACCGTGAAAAATACGAATAATA 23580
E V S Q N Y K * K * * S R P V K * A * *
K * L N T T N E N K D L V H C K K H K N
R C I P Q I K M K I L F T A S K I S I I

23581 CGACTAAGACCGTACGGATGATGAAAAAATAAATCAAACATAGAACCATGAGAAAATAGA 23640
A S E P M G V V K K N L K Y R P V R K D
H Q N Q C A * * K K I * N T D Q Y E K I
S I R A H R S S K * K T Q I K T S K * R

23641 GTAATAATACAAAACGGAAACTGAACATTACGATATAGAAGATTATGACTATTACTCTGA 23700
* * * T K G K V Q L A I D E L V S L S V
E N N H K A K S K Y H * I K * Y Q Y H S
M I I N Q R Q S T I S Y R R I S I I L S

23701 AATGTTATAACCCAGTGTGGAAACAGATTTGCGGTTATAGAAGAATTTAAACTGTTGGCA 23760
K C Y Q T V G K D L R W Y R R L N S L R
K V I N P * V K T * V G I D E * I Q C G
* L I P D C R Q R F A L I K K F K V V T

FIG. 3 CONT'D

```
23761  CCACAATAATGATTACGACAACTAACAAGATCATCAAAGAAATCGCTCTAAGTTACATTT  23820
        P  T  I  V  L  A  T  S  Q  E  L  L  K  K  L  S  I  *  H  L
       H  H  *  *  *  H  Q  Q  N  N  *  Y  N  R  *  R  S  E  I  Y
         T  N  N  S  I  S  N  I  T  R  T  T  E  K  A  L  N  L  T  F

23821  TGATTTAGAAATAATGGATTATGACCACAAATACTGAATAGACCAAAATGACAATTCGGA  23880
        V  L  D  K  N  G  L  V  P  T  *  S  K  D  P  K  V  T  L  G
       F  *  I  K  I  V  *  Y  Q  H  K  H  S  I  Q  N  *  Q  *  A
         S  F  R  *  *  R  I  S  T  N  I  V  *  R  T  K  S  N  L  R

23881  CAACGTTGACATGTAGCAGCATAAGGACTAAATGGACTAACACTGTAACTATTTACCGAA  23940
        T  A  V  T  C  R  R  I  G  S  K  G  S  Q  S  M  S  L  H  S
       Q  Q  L  Q  V  D  D  Y  E  Q  N  V  Q  N  H  C  Q  Y  I  A
         N  C  S  Y  M  T  T  N  R  I  *  R  I  T  V  N  I  F  P  K

23941  TTGTTAAAATTACATGGGAGTGGAGAATTAACCCTTGCATTTTAAAAAAGATTAACGTTG  24000
        L  L  K  L  T  G  E  G  R  L  Q  S  R  L  I  K  E  L  Q  L
       *  C  N  *  H  V  R  V  E  *  N  P  V  Y  F  K  K  *  N  C
         V  I  K  I  Y  G  *  R  K  I  P  F  T  F  N  K  R  I  A  V

24001  AAATTAAACTCATGAAACGAAGCAAATCAAGTATGACTAAGAAAAAGAACATTATTAAAA  24060
        K  L  K  L  V  K  S  R  K  T  *  V  S  E  K  E  Q  L  L  K
       S  *  N  S  Y  K  A  E  N  L  E  Y  Q  N  K  K  K  Y  Y  N
         K  I  Q  T  S  Q  K  T  *  N  M  S  I  R  K  R  T  I  I  K

24061  CTACTTAGATTCTATATACCATCAACAAAATTCTCATAACAAAATCTATTTAAACGGTAT  24120
        S  S  D  L  I  Y  P  L  Q  K  L  L  I  T  K  S  L  N  A  M
       Q  H  I  *  S  I  H  Y  N  N  *  S  Y  Q  K  L  Y  I  Q  W
         I  F  R  L  Y  I  T  T  T  K  L  T  N  N  *  I  F  K  G  Y

24121  GGGTTGAGGTCTGCTAGACTAAACGTCAACCCGTCAAGACCAAAAGACGTTAGAAGATTA  24180
        G  L  E  L  R  D  S  K  C  N  P  L  E  P  K  R  C  D  E  L
       V  W  S  W  V  I  Q  N  A  T  P  C  N  Q  N  E  A  I  K  *
         G  V  G  S  S  R  I  Q  L  Q  A  T  R  T  K  Q  L  R  R  I

24181  ATATTTTAACTGTGATGAAGATCAAGAACAGTTAACATAATATCAAACGGACGTTAATTA  24240
        *  L  I  S  V  V  E  L  E  Q  *  N  Y  *  L  K  G  A  I  L
       N  Y  F  Q  C  *  K  *  N  K  D  I  T  N  Y  N  A  Q  L  *
         I  F  N  V  S  S  R  T  R  T  L  Q  I  I  T  Q  R  C  N  I

24241  CAATGATAATTATTAATATTAGGAAGAAGAACCTTATCTTCCATACCAAAATTATTAAAA  24300
        T  V  I  L  L  *  L  G  E  E  Q  F  L  L  Y  P  K  L  L  K
       H  *  *  *  Y  N  Y  D  K  K  K  S  Y  F  T  H  N  *  Y  N
         N  S  N  I  I  I  I  R  R  R  P  I  S  P  I  T  K  I  I  K
```

FIG. 3 CONT'D

```
24301 TTAAACTCGAGAGTATCACAACAAATGAGTGCAATAACAAAAAGACAATTATTATGAAAA 24360
       L  K  L  E  *  L  T  T  *  E  R  *  Q  K  E  T  L  L  V  K
      *  N  S  S  E  Y  H  Q  K  S  V  N  N  N  K  Q  *  Y  Y  K
        I  Q  A  R  M  T  N  N  V  *  T  I  T  K  R  N  I  I  S  K

24361 ACAGGAACACGATTTGGAAGAAAACGAAGTTCAACGTTCTCAGTATTTGGTGGAAGACGA 24420
       Q  G  Q  A  L  G  E  K  A  E  L  Q  L  L  *  L  G  G  E  A
      K  D  K  H  *  V  K  K  Q  K  L  N  C  S  D  Y  V  V  K  Q
        T  R  T  S  F  R  R  K  S  *  T  A  L  T  M  F  W  R  R  S

24421 AGGACAGGATAACCATGATTAATAGCAAGAACACTCTCATGATGACATGAGCTGGTGTGA 24480
       E  Q  G  I  P  V  L  *  R  E  Q  S  L  V  V  T  S  S  W  V
      K  R  D  *  Q  Y  *  N  D  N  K  H  S  Y  *  Q  V  R  G  C
        G  T  R  N  T  S  I  I  T  R  T  L  T  S  S  Y  E  V  V  S

24481 CTGACCACATCCACAAGAACAAATGGACTAGGATATTGACGAATACTGGGATCCAGAACA 24540
       S  Q  H  L  H  E  Q  K  G  S  G  I  V  A  *  S  G  L  D  Q
      Q  S  T  Y  T  N  K  N  V  Q  D  *  L  Q  K  H  G  *  T  K
        V  P  T  P  T  R  T  *  R  I  R  Y  S  S  I  V  R  P  R  T

24541 AGAGTTTTTTTCAGAGACCAACCACAACCACTTGTAACACGTCCCAAGCCACAACTACTT 24600
       E  *  F  F  D  R  T  P  T  P  S  C  Q  A  P  N  P  T  S  S
      N  E  F  F  T  E  P  Q  H  Q  H  V  N  H  L  T  R  H  Q  H
        R  L  F  L  R  Q  N  T  N  T  F  M  T  C  P  E  T  N  I  F

24601 CTTTTCACACCACATAACCTACCTAGTATATTACAAAGAACAGAAACATCATGACTACGG 24660
       S  F  H  P  T  N  S  P  D  Y  L  T  E  Q  R  Q  L  V  S  A
      L  F  T  H  H  I  P  H  I  M  Y  H  K  K  D  K  Y  Y  Q  H
        F  L  T  T  Y  Q  I  S  *  I  I  N  R  T  K  T  T  S  I  G

24661 AAAGATCCAACCAGAATACTGTGAACGCAGTCATTGTTGGCAACATTATAAAAAAGATTA 24720
       K  R  P  Q  D  *  S  V  Q  T  L  L  L  R  Q  L  I  K  E  L
      R  E  L  N  T  K  H  C  K  R  *  Y  C  G  N  Y  Y  K  K  *
        K  *  T  P  R  I  V  S  A  D  T  V  V  T  T  I  N  K  R  I

24721 AAATAAAATTTACCATAGTTATCACCATGGTGAACAAGATTACTAAATAACGTCGGATTA 24780
       K  I  K  F  P  I  L  L  P  V  V  Q  E  L  S  K  N  C  G  L
      N  *  K  L  H  Y  *  Y  H  Y  W  K  N  *  H  N  I  A  A  *
        K  N  *  I  T  D  I  T  T  G  S  T  R  I  I  *  Q  L  R  I

24781 TGACTTCAAAAATGACTACAAACACAACTAATGCTGGAAATACCATAATGTCCTGTTCCA 24840
       V  S  T  K  V  S  T  Q  T  S  *  S  R  *  P  I  V  P  C  P
      Y  Q  L  K  *  Q  H  K  H  Q  N  R  G  K  H  Y  *  L  V  L
        S  F  N  K  S  I  N  T  N  I  V  V  K  I  T  N  C  S  L  T
```

FIG. 3 CONT'D

24841 TAAAAATTTCTTCAAAGACGACAAATAATATTATCAACCGTTTTAGAAAACATACTAAGA 24900
I K L S T E A T * * L L Q C F R K Y S E
Y K * L L K Q Q K N Y Y N A F D K T H N
N K F F N R S N I I I T P L I K Q I I R

24901 TTACCGTTGTAATAACCAAAATTTCTAAAACAATGATTATTTTGTATATTATAAAAGGGA 24960
L P L M I P K L S K T V L L V Y L I K G
* H C C * Q N * L N Q * * Y F M Y Y K G
I A V N N T K F I K N S I F C I I N E R

24961 ACAATACGTCCTTCTCAAAGACGACGAAAAGTAGTTTTACGAAGGAGAAACCGAAATGAA 25020
Q * A P L T E A A K * * F A E E K A K S
K N H L F L K Q Q K E D F H K R K P K V
T I C S S N R S S K M L I S G R Q S * K

25021 ATAGCATTAAATTTTACATCGATACAAAACTTATTATAAAGAAATTGATGAGTCGGTATA 25080
* R L K F H L * T K F L I E K V V * G Y
K D Y N L I Y S H K S Y Y K K L * E A M
I T I * F T A I N Q I I N R * S S L W I

25081 AAACTATCAATAGAACCAACGCAAAAATTACGACTATTAAATTGACTAATAAGACAAAGA 25140
K S L * R P Q T K L A S L K V S * E T E
N Q Y N D Q N R K * H Q Y N L Q N N Q K
K I T I K T A N K I S I I * S I I R N R

25141 AGAACACGAGAAGCGTACCCATCACCAAAAACACAACTAATATTGAGTGGAAGAAGAAGG 25200
E Q A R R M P L P K Q T S * L E G E E E
K K H E E C P Y H N K H Q N Y S V K K K
R T S K A H T T T K T N I I V * R R R G

25201 AGAAGCGCAGCATTTGCATCTTCATAAAGACGAAGAATAGCAAAACAATGAAAACTTGGG 25260
E E R R L R L L I E A E * R K T V K S G
R K A D Y V Y F Y K Q K K D N Q * K Q V
R R T T F T S T N R S R I T K N S K F G

25261 AAATTACAGTCAAAACAATTACTGTCATAACTCAGACACCCACCAGAAATACTCTAGTTT 25320
K L T L K T L S L I S D T P P R * S I L
R * H * N Q * H C Y Q T Q P H D K H S *
K I D T K N I V T N L R H T T K I L D F

25321 TAAGGGTGATTGAAATGATATCAACCAGTTCTCCTTAAATAAGTTTGATTAAGAGGATTT 25380
I G V L K V I T P * S S N I * V L E G L
F E W * S * * L Q D L P I * E F * N E *
N G S V K S Y N T L L F K N L S I R R F

FIG. 3 CONT'D

```
25381  CAATGATAACTAACAAGAAATAAACAGACAAGATTAATACGTCGAACGGTACTGAATAAC  25440
        T  V  I  S  Q  E  K  N  T  Q  E  L  *  A  A  Q  W  S  K  N
       L  *  *  Q  N  N  K  I  Q  R  N  *  N  H  L  K  G  H  S  I
         N  S  N  I  T  R  *  K  D  T  R  I  I  C  S  A  M  V  *  Q

25441  AGTCTCATACCGTGAAAAACACTATTATAATTATCATAAAATCTACTTCAATTACCAAAT  25500
        D  S  Y  P  V  K  Q  S  L  I  L  L  I  K  S  S  T  L  P  K
       T  L  T  H  C  K  K  H  Y  Y  *  Y  Y  K  L  H  L  *  H  N
         *  L  I  A  S  K  T  I  I  N  I  T  N  *  I  F  N  I  T  *

25501  GAACTATGATGAGTTAACGTACATCGACTATGAGAATACGTTCCACAGTGTGAATCGAGG  25560
        S  S  V  V  *  N  C  T  A  S  V  R  I  C  P  T  V  S  L  E
       V  Q  Y  *  E  I  A  H  L  Q  Y  E  *  A  L  H  *  V  *  S
         K  I  S  S  L  Q  M  Y  S  I  S  K  H  L  T  D  C  K  A  G

25561  TTAGAATTATGATTAAACGTAAAACTACAACTATTATAATTAAAATTTAGGGATCAACCT  25620
        L  R  L  V  L  K  C  K  S  T  S  L  I  L  K  L  D  R  T  P
       W  D  *  Y  *  N  A  N  Q  H  Q  Y  Y  *  N  *  I  G  L  Q
         I  K  I  S  I  Q  M  K  I  N  I  I  N  I  K  F  G  *  N  S

25621  ACAAATCCAGGTGTGACGCCAAGAAGAAGAGCAAGAAAAAAACTTCTAAATAACAAACTG  25680
        H  K  P  G  C  Q  P  E  E  E  R  E  K  K  S  S  K  N  N  S
       I  N  L  D  V  S  R  N  K  K  E  N  K  K  Q  L  N  I  T  Q
         T  *  T  W  V  A  T  R  R  R  T  R  K  K  F  I  *  Q  K  V

25681  TTTCAATTTGAAAGTCTACAACCAAAACAACTTCGAATATTGTTAACATGACCACCATCA  25740
        L  T  L  S  E  S  T  P  K  T  S  A  *  L  L  Q  V  P  P  L
       C  L  *  V  K  L  H  Q  N  Q  Q  L  K  Y  C  N  Y  Q  H  Y
         F  N  F  K  *  I  N  T  K  N  F  S  I  V  I  T  S  T  T  T

25741  CTTTAATCTCTAGAAGAAACACATGTTAGGAAATTACCATAATTTCAAAACGGAGGATAA  25800
        S  I  L  S  R  R  Q  T  C  D  K  L  P  I  L  T  K  G  G  I
       H  F  *  L  D  E  K  H  V  I  R  *  H  Y  *  L  K  A  E  *
         F  N  S  I  K  K  T  Y  L  G  K  I  T  N  F  N  Q  R  R  N

25801  AACAGACTTAGAGTTTAAAGACCAATGTGGTGTCGGCGATGACAACGACGATACAAAGGT  25860
        K  D  S  D  *  I  E  P  *  V  V  A  A  V  T  A  A  I  N  G
       K  T  Q  I  E  F  K  Q  N  C  W  L  R  *  Q  Q  Q  *  T  E
         Q  R  F  R  L  N  R  T  V  G  C  G  S  S  N  S  S  H  K  W

25861  GGTACCAGTCGTCGTCGACCGTATGGTAAAAGAGAATTACATGTTATATCTTAATTACCA  25920
        G  H  D  A  A  A  P  M  G  N  E  R  L  T  C  Y  L  I  L  P
       V  M  T  L  L  L  Q  C  V  M  K  E  *  H  V  I  Y  F  *  H
         W  P  *  C  C  S  A  Y  W  K  R  K  I  Y  L  I  S  N  I  T
```

FIG. 3 CONT'D

```
25921  AACCCACAATGATACCTACAAGAATTATTTTTAGTTTTCAACTATCGATGACGAAAATTA  25980
        K  P  T  V  I  S  T  R  L  L  F  *  F  N  I  A  V  A  K  L
       N  P  H  *  *  P  H  E  *  Y  F  D  F  T  S  L  *  Q  K  *
         Q  T  N  S  H  I  N  K  I  F  I  L  L  Q  Y  S  S  S  K  I

25981  TTACGAGAAGAAAGATAAGTCTTACCAAAATCACGATGGTTGAGACGTGAACGATTTTAT  26040
        L  A  R  R  E  I  *  F  P  K  L  A  V  L  E  A  S  A  L  I
       Y  H  E  E  K  *  E  S  H  N  *  H  *  W  S  Q  V  Q  *  F
         I  S  K  K  R  N  L  I  T  K  T  S  G  V  R  C  K  S  F  Y

26041  GTTTCACAACAATTAAGATTACGAGTTCGTGAATTATCAAACAATGTCGTTAATAAATTA  26100
        C  L  T  T  L  E  L  A  *  A  S  L  L  K  N  C  C  N  N  L
       V  F  H  Q  *  N  *  H  E  L  V  *  Y  N  T  V  A  I  I  *
         L  T  N  N  I  R  I  S  L  C  K  I  T  Q  *  L  L  *  K  I

26101  TTTAAACCACGTTAATCAAGAAGAAATGTTCTTTAAAATAGAGCAGAGCTACGAAATCTC  26160
        L  N  P  A  I  L  E  E  K  C  S  I  K  D  R  R  S  A  K  S
       Y  I  Q  H  L  *  N  K  K  V  L  F  K  I  E  D  R  H  K  L
         F  K  T  C  N  T  R  R  *  L  F  N  *  R  T  E  I  S  *  L

26161  CGAGTCCAAGTCTAACTATCCGAATAATTACCAGCAAATTGACGAAATTTACGAATACAG  26220
        A  *  T  *  I  S  L  S  I  L  P  R  K  V  A  K  F  A  *  T
       P  E  P  E  S  Q  Y  A  *  *  H  D  N  L  Q  K  L  H  K  H
         S  L  N  L  N  I  P  K  N  I  T  T  *  S  S  *  I  S  I  D

26221  AGAGTTGTCGAATCACTATAAAGAGAACATTTTAAACCACGACGAAATCGATACCTCTTC  26280
        E  *  C  S  L  S  I  E  R  T  F  N  P  A  A  K  A  I  S  F
       R  E  V  A  *  H  Y  K  E  Q  L  I  Q  H  Q  K  L  *  P  S
         R  L  L  K  T  I  N  R  K  Y  F  K  T  S  S  *  S  H  L  L

26281  CAATTACTCACACAATTTTCAGTTAGAGGAGCATAATTAAAAACACCATTACCATTAGTA  26340
        T  L  S  H  T  L  L  *  D  G  R  I  L  K  Q  P  L  P  L  *
       P  *  H  T  H  *  F  D  I  E  E  Y  *  N  K  H  Y  H  Y  D
         N  I  L  T  N  F  T  L  R  R  T  N  I  K  T  T  I  T  I  M

26341  TAAAACAGTAATCAAGTTTTACGAGGAATACCAAACAACAAATACGTAAAATCAATATTT  26400
        I  K  D  N  T  *  F  A  G  *  P  K  N  N  I  C  K  L  *  L
       Y  K  T  M  L  E  F  H  E  K  H  N  T  T  *  A  N  *  N  Y
         N  Q  *  *  N  L  I  S  R  I  T  Q  Q  K  H  M  K  T  I  F

26401  GGATAAAGAAAATTTTGACAAAATCATTCAGGACCAAACACATATAGTCCACTACATCCA  26460
        G  I  E  K  L  V  T  K  T  L  G  P  K  H  I  D  P  S  T  P
       V  *  K  K  *  F  Q  K  L  L  D  Q  N  T  Y  I  L  H  H  L
         R  N  R  K  F  S  N  *  Y  T  R  T  Q  T  Y  *  T  I  Y  T
```

FIG. 3 CONT'D

```
26461  TAACGTGGATTTGTTCCCATAAAATAATTTGTATTACTAGTAACCTACAAGTGACCATCA  26520
        I  A  G  L  C  P  Y  K  I  L  C  L  S  *  Q  I  N  V  P  L
       Y  Q  V  *  V  L  T  N  *  *  V  Y  H  D  N  S  T  *  Q  Y
         N  C  R  F  L  P  I  K  N  F  M  I  I  M  P  H  E  S  T  T

26521  AGAATGATAATAGGACTTGGTTAAAGTCTATTTTTACAACAAAAATACTTATGAACAAGA  26580
        E  *  *  *  G  S  G  I  E  S  L  F  T  T  K  I  F  V  Q  E
       N  K  S  N  D  Q  V  L  K  L  Y  F  H  Q  K  *  S  Y  K  N
         R  V  I  I  R  F  W  N  *  I  F  I  N  N  K  H  I  S  T  R

26581  CAATTAAAATGATTTCGCGGAGAACAAATAAACTTAGTAAGACATGGTTTTAACAGACTA  26640
        T  L  K  V  L  A  G  R  T  *  K  F  *  E  T  G  F  N  D  S
       Q  *  N  *  *  L  A  E  Q  K  N  S  D  N  Q  V  L  I  T  Q
         N  I  K  S  F  R  R  K  N  I  Q  I  M  R  Y  W  F  Q  R  I

26641  AAACTTAGACTCAATAGAGTAACCAAATTTTTAGTTTGTAGGTAACGCGGATTAAACTGA  26700
        K  S  D  S  N  D  *  Q  N  L  F  *  V  D  M  A  G  L  K  V
       N  Q  I  Q  T  I  E  N  T  *  F  D  F  M  W  Q  A  *  N  S
         K  F  R  L  *  R  M  P  K  F  I  L  C  G  N  R  R  I  Q  S

26701  AATTTAGAAGTATGATAATTACGATGAAAAAATCTAAACATAATACTCTACTTAGAATAA  26760
        K  F  R  *  V  I  L  A  V  K  K  S  K  Y  *  S  I  F  R  I
       K  L  D  E  Y  *  *  H  *  K  K  L  N  T  N  H  S  S  D  *
         *  I  K  M  S  N  I  S  S  K  *  I  Q  I  I  L  H  I  K  N

26761  GTTCTCAGATAATTCAGAAACTTATTATCAATATAGTTAGAATTTCTATATCCATGTATA  26820
        *  S  D  I  L  D  K  F  L  L  *  I  L  R  L  S  I  P  V  Y
       E  L  T  *  *  T  K  S  Y  Y  N  Y  *  D  *  L  Y  L  Y  M
         L  L  R  N  L  R  Q  I  I  T  I  D  I  K  F  I  Y  T  C  I

26821  CTTTACATACATTTTACCGGAACCATACAAACCGATGATTAAAGAAAAAGTAAATATTAT  26880
        S  I  Y  T  F  H  G  Q  Y  T  Q  S  S  I  E  K  E  N  I  I
       H  F  T  H  L  I  A  K  T  H  K  A  V  L  K  K  K  M  *  L
         F  H  I  Y  F  P  R  P  I  N  P  *  *  N  R  K  *  K  Y  Y

26881  AAGGAACATAACGAGAAAAAATATACAACAACATGACCAACACCAAGACGTACAAAATCA  26940
        N  R  T  N  S  K  K  I  H  Q  Q  V  P  Q  P  E  A  H  K  L
       I  G  Q  I  A  R  K  *  I  N  N  Y  Q  N  H  N  Q  M  N  *
         E  K  Y  Q  E  K  K  Y  T  T  T  S  T  T  T  R  C  T  K  T

26941  TTTACAGTATTAACAACACTACTCATACCACCAGTAGTACTAAAACAATAGTTTTGTAGA  27000
        L  H  *  L  Q  Q  S  S  Y  P  P  *  *  S  K  T  I  L  V  D
       Y  I  D  Y  N  N  H  H  T  H  H  D  D  H  N  Q  *  *  F  M
         F  T  M  I  T  T  I  L  I  T  T  M  M  I  K  N  D  F  C  R
```

FIG. 3 CONT'D

27001 GTACTACTAATCTTAGAGAACAGTCTAGAGTAATTTAGATTTGAAATAAATACCTGCAAA 27060
* S S * F R K D S R M L D L S * K H V N
E H H N S D R T L D * * I * V K N I S T
M I I L I E Q * I E N F R F K I * P R K

27061 CCTCTGGATCGATGTGTGTAAGAGAACAATAATCTCTTAAACCACAATGTTTGGAACTTC 27120
P S R A V C M R K N N S F K T N C V K F
Q L G L * V C E R T I L S N P T V F R S
S V * S C V N E Q * * L I Q H * L G Q L

27121 TAAACACAGATTTCATATTAATGACAGTTGGATAACAACCAATGACATAACATGGAAATT 27180
I Q T * L I I V T L R N N T V T N Y R *
S K H R F Y L * Q * G I T P * Q I T G K
N T D L T Y N S D V * Q Q N S Y Q V K L

27181 TACAAACCACAGCGTTCAAACCGTTTAAACGAAGAGTGAAATGTAATGCATCAGTGCTAT 27240
I N P T A L K A F K S R V K C * T T V I
F T Q H R L N P L N A E * K V N R L * S
H K T D C T Q C I Q K E S * M V Y D R Y

27241 AAAGGGTATCATTATTAAAACCACAACATTGATCAAAATGATGAATACCATTATGACAAA 27300
N G M T I I K T N Y S T K S S I T I S N
I E W L L L K P T T V L K V V * P L V T
K G Y Y Y N Q H Q L * N * * K H Y Y Q K

27301 GACTCCGACACAGATCTAATCAACTTAGTCGAAGACTTAAATAACAAACCGCACGTCTCC 27360
R L S H R S * N F * S R F K N N P T C L
E S A T D L N T S D A E S N I T Q R A S
Q P Q T * I L Q I L K Q I * Q K A H L P

27361 GTGAATTATTCATACCAACTAAATAAAAAGTTACTATGACGAACCATGTATCCTGTCTAA 27420
C K I L I T S K N K L S V A Q Y M P C I
A S L L Y P Q N I K * H Y Q K T C L V S
V * Y T H N I * K E I I S S P V Y S L N

27421 AATCAAAATCAAAATAAAACAGAATAAAGAAATTAGAAACAACAACGAAAAAATCGTTGA 27480
K T K T K N Q R I E K I K T T A K K A V
K L K L K I K D * K K L R Q Q Q K K L L
* N * N * K T K N R * D K N N S K * C S

27481 TAATTCGAAACATACGTTGAAACACCAAAAACATTAAAGAAATAATAAAGTGGAAGCCGA 27540
I L S Q I C S Q P K Q L K K I I E G E A
* * A K Y A V K H N K Y N R * * K V K P
N L K T H L K T T K T I E K N N * R R S

FIG. 3 CONT'D

27541 ATGCAAATATTTTCTCCATACGTCAACATATTCAGAATATCACTTGTTCAATATGGTGGG 27600
* T * L L P I C N Y L D * L S C T I G G
K R K Y F L Y A T T Y T K Y H V L * V V
V N I F S T H L Q I L R I T F L N Y W G

27601 TGAAGTCTAATAAATTAGATTTAGATTTGTAATACTTATTTAGAAAAGAAGGAGTTAAAT 27660
V E S * K I * I * V N H I F R K K R L K
W K L N N L R F R F M I F L D K R G * N
S * I I * D L D L C * S Y I K E E E I *

27661 GAAGACTAGTTCGACAATGTAAGAATTTTCTTACCTTAAAGAGAAACCCACATTATGATG 27720
S R I L S N C E * F F P I E R Q T Y Y *
V E S * A T V N K F S H F K E K P T I S
K Q D L Q * M R L L I S N R K P H L V V

27721 AAAAATAATGATAGTATAACGTCAAGCCAATATGCTCGGCATCATACAAACAAATAGAAT 27780
K K N S D Y Q L E T I R A T T H K N I K
S K I V I M N C N P * V L R L I N T * R
K * * * * I A T R N Y S G Y Y T Q K D *

27781 AGTTCTACTAATAAGAAACCGAATACACCGGTAACTGATAGTGGAACTGATATAAATTAA 27840
D L H N N K P K H P W Q S D G Q S Y K I
I L I I I R Q S I H G N V I V K V I N L
* S S * E K A * T A M S * * R S * I * N

27841 CAAAAATACGAAACTTATTACGAAAAGAACGTAAAAGATATCACAAATGATAATAAAGAT 27900
T K I S Q I I S K K C K R Y H K S N N R
Q K * A K F L A K R A N E I T N V I I E
N K H K S Y H K E Q M K * L T * * * K *

27901 AACAATATACCTAAGAAATAAAACAATTATCATAAGCCGAAAAAATAATCTTGACCGTCAA 27960
N N Y P N K I K N I T N P K K N S S A T
I T I H I R * K T L L I R S K I L V P L
Q * I S E K N Q * Y Y E A K * * F Q C N

27961 CCACCTCAAAATTAGGTCTCTGGTTATTAGAATACACATAACTATACTTTCCGTTCTACA 28020
P P T K I W L G I I K H T N I H F A L H
Q H L K L G S V L L R I H I S I F P L I
T S N * D L S W Y D * T Y Q Y S L C S T

28021 AACAATCCGGTCAATAACTCCTGATAGTGTGTAATTGACGATGACAATAAGCACCAGTAG 28080
K N P W N N L V I V C * S S S N N T T M
N T L G T I S S * * V N V A V T I R P *
Q * A L * Q P S D C M L Q * Q * E H D D

FIG. 3 CONT'D

28081 AAATATATGTCCCACAGTTTGAACCGTGACCAATATGAGAAAGTCTAAACGGGCATATAC 28140
K I Y L T D F K A S T I S K * I Q G Y I
R * I C P T L S P V P * V R E S K G T Y
K Y V P H * V Q C Q N Y E K L N A R I H

28141 AATGACATCGATTCCACGTTCATGAAACATGGATATTTGCACGGAAAAATCTATTCAATC 28200
N S Y S L H L Y K T G I F T G K * I L *
T V T A L T C T S Q V * L R A K K S L N
* Q L * P A L V K Y R Y V H R K L Y T L

28201 TACAATTATCACCAAAACGACAAAAACAATTCAGATTTCAACCATTGATAGCAAATGGCA 28260
I N I T T K S N K N L R F N T V I T * R
S T L L P K A T K T L D L T P L * R K G
H * Y H N Q Q K Q * T * L Q Y S D N V T

28261 GATCATTTGGATCACCATACCTATGACGGAACAATTCTCGAATTTAGATTTGATAATCCT 28320
R T F R T T H I S G Q * S S L D L S N P
D L L G L P I S V A K N L A * I * V I L
* Y V * H Y P Y Q R T L L K F R F * * S

28321 ACAGAATATGAGGGCCAGTAATACGACCTTCATCTTCGAGGAGACCTTTAGCAAGTCCTT 28380
H R I S G T M I S S T S A G R S I T * S
I D * V G P * * A P L L L E E P F R E P
T K Y E R D N H Q F Y F S R Q F D N L F

28381 AGGAGTTCTTTTGAAGAACCCGACTGGTTAGACTCGCTTTAATGGTTTGGAAATTATCTC 28440
D E L F S R P S V L R L S I V L G K I S
I R L F V E Q A S W D S R F * W V K L L
G * S F K K P Q G I Q A F N G F R * Y L

28441 CGTCTTTTTGGGTTGGATTTAAGTGACACAGATGAGTTGGTGTTCCTTTATGATAGGGTG 28500
A S F G L R F E S H R S L W L S I S D W
P L F V W G L N V T D V * G C P F V I G
C F F G V * I * Q T * E V V L F Y * G V

28501 TAATAAGGACCAAGAGGCCCTAGTGAGTTAAAGTTTTTCCATCTCTGAAATTTAAAAGTC 28560
M I G P E G P D S L K L F T S V K F K *
C * E Q N E P I V * N * F P L S K L N E
N N R T R R S * E I E F L Y L S * I K L

28561 TACCAGTTCCTCAAGGGTAACGAAAGCCTCATGGGGGAAGACTTCGTTTTCCTATAACCA 28620
I T L S N G N S E S Y G R R F C F S I P
S P * P T G M A K P T G G E S A F P Y Q
H D L L E W Q K R L V G K Q L L L I N T

FIG. 3 CONT'D

28621 TATCTGTGTCGGCCGCAAGAAAATTTTGTCGACTACCAGTTGTTTTCGTCAACAATGGCT 28680
I S V A P T R K F C S I T L L L L Q * R
Y L C L R R E K L V A S P * C F C N N G
Y V C G A N K * F L Q H D V F A T T V S

28681 CTACCATAAAGATGATAGAGCCATGGCCGGGTATACGGTTACGTAGGATACCACTTAGGG 28740
S P I E V I E T G A W I G I C G I T F G
L H Y K * * R P V P G Y A L A D * P S D
I T N R S D R Y R G M H W H M R H H I G

28741 AGCTTCCCCAGAAGACCCAACGATTAGTGGTTCGACTGTGAAGATGAGGGAGGCTACAAA 28800
E F P D E P N S I V L S V S R S G G I N
R S P T K Q T A L * W A S V E V G E S T
R L P R R P Q * D G L Q C K * E R R H K

28801 GCAGTTCCCTAGGATGATGAGTTCTTCGATAGGGATGATCCAAAGGCGGACCATGCTAAA 28860
R * P I R S S L F S D R S P K R R T R N
E D L S G V V * S A I G V L N G G P V I
T L P D * * E L L * G * * T E A Q Y S K

28861 ACGGAGTTCCGATAATACAACTTCCGAGTCCTTCCAGACGAAGATTATCAGCTGGTCCAA 28920
Q R L A I I N F A * S P R S R I T S W T
K G * P * * T S P E P L D A E L L R G P
A E L S N H Q L S L F T Q K * Y D V L N

28921 GTGCAAGAGTTAGTGCACCTGGGTTATTAGCAAGTAATTCATCTTCATTAAGATTAAAAT 28980
* T R L * T S G I I T * * T S T I R I K
E R E * D R P G L L R E N L L L L E L K
V N E I V H V W Y D N M L Y F Y N * N *

28981 CTGTAAGTCTAAGATATCATTTTGGACTATACCGACTACTCTAGCGATTAGAACAAAATC 29040
S M * I R Y Y F R I H S I L D S I K N *
L C E S E I T F G S I A S S I A L R T K
V N L N * L L V Q Y P Q H S R * D Q K L

29041 GGTTCGAACCATTTCTAAGATTTGGAGTCGTTCAGTGATTCGTTTTACGGTTCCTTTAGT 29100
G L K T F I R F R L L D S L L I G L F D
A L S P L S E L G * C T V L C F A L S I
W A Q Y L N * V E A L * * A F H W P F *

29101 CCGTATTTTAAAATTGTTTTGGAGCGGTTTTCGCTTGAGGATTATTTGTAACATTACAAG 29160
P M F N * C F R A L L S S R I F M T I N
L C L I K V F G R W F R V G L L C Q L T
A Y F K L L V E G F A F E * Y V N Y H E

FIG. 3 CONT'D

```
29161  TTGTCACAAAACCATTTTCTCCTGGAAGAGTTTTAAAACCATTACGACTTTACAATTTCG  29220
        L  L  T  K  T  F  S  S  R  R  L  I  K  T  I  S  F  H  *  L
       *  C  H  K  P  L  L  P  G  E  *  F  K  P  L  A  S  I  N  F
         V  T  N  Q  Y  F  L  V  K  E  F  N  Q  Y  H  Q  F  T  L  A

29221  AACCATGATTACTAGGAGTCAAAGGATAAGAACGTCTTAATCGAGGATGTGGTCCACGAA  29280
        K  T  S  I  I  R  L  K  R  N  K  C  F  *  S  R  C  W  T  S
       S  P  V  L  S  G  *  N  G  I  R  A  S  N  A  G  V  G  P  A
         Q  Y  *  H  D  E  T  E  *  E  Q  L  I  L  E  *  V  L  H  K

29281  AAAAGAAACCAAGATTTAATCTGAACCAATTTTCTCTAAGGCTCCGACTGAGTGGACAAT  29340
        K  E  K  T  R  F  *  V  Q  N  F  S  I  G  L  S  V  *  R  N
       K  K  K  P  E  L  N  S  K  T  L  L  S  E  S  A  S  E  G  T
         K  R  Q  N  *  I  L  S  P  *  F  L  N  R  P  Q  S  V  Q  *

29341  TTCTACAAAAACTTGAAGTAATAAGACCAAGATAATCCAAACTATCATGAAATGGTCCGA  29400
        F  I  N  K  F  K  M  I  R  T  R  N  P  K  I  T  S  *  W  A
       L  S  T  K  S  S  *  *  E  P  E  I  L  N  S  L  V  K  G  P
         L  H  K  Q  V  E  N  N  Q  N  *  *  T  Q  Y  Y  K  V  L  S

29401  AACTCTGTTAATACTTTCAAGAACTTCTCTTAAATTTACGAATGCAATTAAGATTAGTCT  29460
        K  L  C  N  H  F  N  K  F  L  I  *  I  S  V  N  I  R  I  L
       K  S  V  I  I  F  T  R  S  S  F  K  F  A  *  T  L  E  L  *
         Q  S  L  *  S  L  E  Q  L  S  N  L  H  K  R  *  N  *  D  S

29461  TGTGACTAAGACTAAGCAACTCAAGATTTGGAGTCGCATTTTCTCCACAATTTGTTAATG  29520
        V  S  I  R  I  R  Q  T  R  F  R  L  T  F  S  T  N  F  L  *
       F  V  S  E  S  E  N  L  E  L  G  *  R  L  L  P  T  L  C  N
         C  Q  N  Q  N  T  S  N  *  V  E  A  Y  F  L  H  *  V  I  V

29521  GTCTTGTCAAACTGAGAGAATTAAATTCACGACCATGAGTCGTGTAAAGTTTACTAAAAT  29580
        W  F  L  K  V  R  K  I  *  T  S  T  S  L  V  N  *  I  I  K
       G  S  C  N  S  E  R  L  K  L  A  P  V  *  C  M  E  F  S  K
         L  V  T  Q  S  E  *  N  L  H  Q  Y  E  A  C  K  L  H  N  *

29581  GAGGACTCCTAGTATCAAATGAACGATGAGAACTACTAGGAATACATCTTCTGAGACAAC  29640
        S  R  L  I  M  T  *  K  S  S  K  I  I  R  I  Y  F  V  R  N
       V  G  S  S  *  L  K  S  A  V  R  S  S  G  *  T  S  S  E  T
         E  Q  P  D  Y  N  V  Q  *  E  Q  H  D  K  H  L  L  S  Q  Q

29641  GAATTACTCTTACTTAGGATTAAGCTGTGATCCACCATTGGGGAGCGATAATAAGCCTTA  29700
        S  L  S  F  S  D  *  N  S  V  L  H  Y  G  R  A  I  I  R  F
       A  *  H  S  H  I  R  I  R  C  *  T  T  V  G  R  *  *  E  S
         K  I  L  I  F  G  L  E  V  S  P  P  L  G  E  S  N  N  P  I
```

FIG. 3 CONT'D

```
29701  TCCTGTGAGAGATAGTCTTACTTAAGAACGACATTATTGTCTATCTCATCCAACAATGTC  29760
        L  V  S  E  I  L  I  F  E  Q  Q  L  L  L  Y  L  L  N  N  C
       Y  S  V  R  *  *  F  S  N  K  S  Y  Y  C  I  S  Y  T  T  V
         P  C  E  R  D  S  H  I  R  A  T  I  V  S  L  T  P  Q  *  L

29761  TGATATATAATTAATCATCTTTAAAATATAAATCTGTAAACTAACAATCTCATCAATATT  29820
        V  I  Y  *  N  T  S  I  K  Y  K  S  M  Q  N  N  S  Y  N  Y
       S  *  I  N  I  L  L  F  K  I  N  L  C  K  I  T  L  T  T  I
         S  Y  I  L  *  Y  F  N  *  I  *  V  N  S  Q  *  L  L  *  L

29821  CCAAATCGACATCATATTTGCGGAGGCCCTTCTCGATAGTTAACATCACAAATTATATAT  29880
        P  K  A  T  T  Y  V  G  G  P  L  A  I  L  Q  L  T  *  Y  I
       L  N  L  Q  L  I  F  A  E  P  F  L  *  *  N  Y  H  K  I  Y
         T  *  S  Y  Y  L  R  R  R  S  S  S  D  I  T  T  N  L  I  Y

29881  ATAATCATATACTAACTTTAATTAATATCGGAAAACCTCCTTAATGTTTTTTTTTTTTTT  29940
        Y  *  Y  I  I  S  I  L  *  L  R  K  S  S  N  C  F  F  F  F
       I  N  T  Y  S  Q  F  *  N  Y  G  K  P  P  I  V  F  F  F  F
         I  L  I  H  N  F  N  I  I  A  K  Q  L  F  *  L  F  F  F  F

29941  TT                                                            29942
        F
       F
```

FIG. 3 CONT'D

```
  1 GAATAAGAGCGAATTGCGTCCGTACCGTCTATCAGCTTACGATCTCTTGTCAGATCTCAT 60
    E  *  E  R  I  A  S  V  P  S  I  S  L  R  S  L  V  R  S  H
     N  K  S  E  L  R  P  Y  R  L  S  A  Y  D  L  L  S  D  L  I
      I  R  A  N  C  V  R  T  V  Y  Q  L  T  I  S  C  Q  I  S  L

 61 TAAATCTAAACTTTTTAAACAAGATTCCCTGTTATCCATGCTTGTGAGTGTGGTTTAATC 120
    *  I  *  T  F  *  T  R  F  P  V  I  H  A  C  E  C  G  L  I
     K  S  K  L  F  K  Q  D  S  L  L  S  M  L  V  S  V  V  *  S
      N  L  N  F  L  N  K  I  P  C  Y  P  C  L  *  V  W  F  N  H

121 ATAATCTTGTATTTTACTTTCCACACTTTTCATCTCTCTGCCAGTGACGTGTTGGTTGTC 180
    I  I  L  Y  F  T  F  H  T  F  H  L  S  A  S  D  V  L  V  V
     *  S  C  I  L  L  S  T  L  F  I  S  L  P  V  T  C  W  L  S
      N  L  V  F  Y  F  P  H  F  S  S  L  C  Q  *  R  V  G  C  P

181 CTCAGCGTCCCTCCCATAGGTCGCAATGATTAAAACCAGCAAATACGGTCTCGGCTTCAA 240
    L  S  V  P  P  I  G  R  N  D  *  N  Q  Q  I  R  S  R  L  Q
     S  A  S  L  P  *  V  A  M  I  K  T  S  K  Y  G  L  G  F  K
      Q  R  P  S  H  R  S  Q  *  L  K  P  A  N  T  V  S  A  S  S

241 GTGGGCGCCAGAATTTCGTTGGCTGCTTCCGGATGCAGCGGAGGAGTTGGCTAGTCCTAT 300
    V  G  A  R  I  S  L  A  A  S  G  C  S  G  G  V  G  *  S  Y
     W  A  P  E  F  R  W  L  L  P  D  A  A  E  E  L  A  S  P  M
      G  R  Q  N  F  V  G  C  F  R  M  Q  R  R  S  W  L  V  L  *

301 GAAGTCAGATGAGGGTGGGTTATGCCCCTCTACTGGTCAAGCGATGGAAAGTGTTGGATT 360
    E  V  R  *  G  W  V  M  P  L  Y  W  S  S  D  G  K  C  W  I
     K  S  D  E  G  G  L  C  P  S  T  G  Q  A  M  E  S  V  G  F
      S  Q  M  R  V  G  Y  A  P  L  L  V  K  R  W  K  V  L  D  L

361 TGTTTATGATAATCATGTGAAGATAGATTGTCGCTGCATTCTTGGACAAGAATGGCATGT 420
    C  L  *  *  S  C  E  D  R  L  S  L  H  S  W  T  R  M  A  C
     V  Y  D  N  H  V  K  I  D  C  R  C  I  L  G  Q  E  W  H  V
      F  M  I  I  M  *  R  *  I  V  A  A  F  L  D  K  N  G  M  C

421 GCAGTCAAATCTTATCCGTGATATTTTTGTTCATGAAGATCTACATGTTGTAGAAGTTCT 480
    A  V  K  S  Y  P  *  Y  F  C  S  *  R  S  T  C  C  R  S  S
     Q  S  N  L  I  R  D  I  F  V  H  E  D  L  H  V  V  E  V  L
      S  Q  I  L  S  V  I  F  L  F  M  K  I  Y  M  L  *  K  F  *

481 AACTAAAACAGCCGTAAAGTCCGGTACGGCAATTTTAATTAAATCACCTTTGCATAGCTT 540
    N  *  N  S  R  K  V  R  Y  G  N  F  N  *  I  T  F  A  *  L
     T  K  T  A  V  K  S  G  T  A  I  L  I  K  S  P  L  H  S  L
      L  K  Q  P  *  S  P  V  R  Q  F  *  L  N  H  L  C  I  A  W
```

FIG. 9

```
541 GGGTGGTTTTCCTAAAGGGTATGTTATGGGCTTGTTCCGTTCATACAAGACTAAACGTTA 600
     G  W  F  S  *  R  V  C  Y  G  L  V  P  F  I  Q  D  *  T  L
      G  G  F  P  K  G  Y  V  M  G  L  F  R  S  Y  K  T  K  R  Y
    .  V  V  F  L  K  G  M  L  W  A  C  S  V  H  T  R  L  N  V  M

601 TGTTGTACATCATCTTTCTATGACTACATCTACTACTAATTTTGGTGAAGATTTTTTGGG 660
     C  C  T  S  S  F  Y  D  Y  I  Y  Y  *  F  W  *  R  F  F  G
      V  V  H  H  L  S  M  T  T  S  T  T  N  F  G  E  D  F  L  G
       L  Y  I  I  F  L  *  L  H  L  L  L  I  L  V  K  I  F  W  V

661 TTGGATTGTACCTTTTGGTTTTATGCCATCTTATGTTCACAAATGGTTTCAATTCTGTAG 720
     L  D  C  T  F  W  F  Y  A  I  L  C  S  Q  M  V  S  I  L  *
      W  I  V  P  F  G  F  M  P  S  Y  V  H  K  W  F  Q  F  C  R
       G  L  Y  L  L  V  L  C  H  L  M  F  T  N  G  F  N  S  V  G

721 GTTGTATATTGAAGAGAGTGATTTAATAATTTCAAATTTTAAATTTGATGATTATGATTT 780
     V  V  Y  *  R  E  *  F  N  N  F  K  F  *  I  *  *  L  *  F
      L  Y  I  E  E  S  D  L  I  I  S  N  F  K  F  D  D  Y  D  F
       C  I  L  K  R  V  I  *  *  F  Q  I  L  N  L  M  I  M  I  L

781 TAGTGTAGAAGATGCTTATGCTGAGGTTCATGCTGAGCCTAAAGGTAAATATTCACAAAA 840
     *  C  R  R  C  L  C  *  G  S  C  *  A  *  R  *  I  F  T  K
      S  V  E  D  A  Y  A  E  V  H  A  E  P  K  G  K  Y  S  Q  K
       V  *  K  M  L  M  L  R  F  M  L  S  L  K  V  N  I  H  K  K

841 AGCTTATGCTTTACTTAGACAATATCGTGGTATTAAACCCGTACTCTTTGTAGACCAGTA 900
     S  L  C  F  T  *  T  I  S  W  Y  *  T  R  T  L  C  R  P  V
      A  Y  A  L  L  R  Q  Y  R  G  I  K  P  V  L  F  V  D  Q  Y
       L  M  L  Y  L  D  N  I  V  V  L  N  P  Y  S  L  *  T  S  M

901 TGGTTGTGACTATTCTGGTAAATTAGCAGATTGTCTTCAAGCTTATGGTCATTATTCTTT 960
     W  L  *  L  F  W  *  I  S  R  L  S  S  S  L  W  S  L  F  F
      G  C  D  Y  S  G  K  L  A  D  C  L  Q  A  Y  G  H  Y  S  L
       V  V  T  I  L  V  N  *  Q  I  V  F  K  L  M  V  I  I  L  C

961 GCAAGATATGAGACAAAAGCAGTCTGTATGGCTTGCCAATTGCGACTTTGATATTGTAGT 1020
     A  R  Y  E  T  K  A  V  C  M  A  C  Q  L  R  L  *  Y  C  S
      Q  D  M  R  Q  K  Q  S  V  W  L  A  N  C  D  F  D  I  V  V
       K  I  *  D  K  S  S  L  Y  G  L  P  I  A  T  L  I  L  *  W

1021 GGCTTGGCATGTAGTTCGTGATTCACGATTTGTTATGCGCCTGCAGACTATAGCTACTAT 1080
      G  L  A  C  S  S  *  F  T  I  C  Y  A  P  A  D  Y  S  Y  Y
       A  W  H  V  V  R  D  S  R  F  V  M  R  L  Q  T  I  A  T  I
        L  G  M  *  F  V  I  H  D  L  L  C  A  C  R  L  *  L  L  F
```

FIG. 9 CONT.

```
1081 TTGTGGTATTAAATATGTTGCACAACCTACAGAAGATGTAGTAGATGGAGCTGTAGTTAT 1140
     L  W  Y  *  I  C  C  T  T  Y  R  R  C  S  R  W  S  C  S  Y
      C  G  I  K  Y  V  A  Q  P  T  E  D  V  V  D  G  A  V  V  I
       V  V  L  N  M  L  H  N  L  Q  K  M  *  *  M  E  L  *  L  Y

1141 ACGTGAACCTGTACATTTATTATCTGCTGATGCAATAGTTTTAAAGCTTCCTAGTTTGAT 1200
     T  *  T  C  T  F  I  I  C  *  C  N  S  F  K  A  S  *  F  D
      R  E  P  V  H  L  L  S  A  D  A  I  V  L  K  L  P  S  L  M
       V  N  L  Y  I  Y  Y  L  L  M  Q  *  F  *  S  F  L  V  *  *

1201 GAAAGTTATGACTCATATGGATGATTTTTCTATTAAATCTATATACAATGTTGATTTGTG 1260
     E  S  Y  D  S  Y  G  *  F  F  Y  *  I  Y  I  Q  C  *  F  V
      K  V  M  T  H  M  D  D  F  S  I  K  S  I  Y  N  V  D  L  C
       K  L  *  L  I  W  M  I  F  L  L  N  L  Y  T  M  L  I  C  V

1261 TGATTGTGGTTTTGTTATGCAGTATGGTTATGTAGATTGTTTTAATGATAATTGTGATTT 1320
     *  L  W  F  C  Y  A  V  W  L  C  R  L  F  *  *  *  L  *  F
      D  C  G  F  V  M  Q  Y  G  Y  V  D  C  F  N  D  N  C  D  F
       I  V  V  L  L  C  S  M  V  M  *  I  V  L  M  I  I  V  I  F

1321 TTATGGTTGGGTTTCAGGTAATATGATGGATGGTTTTTCTTGTCCATTGTGTTGTACAGT 1380
     L  W  L  G  F  R  *  Y  D  G  W  F  F  L  S  I  V  L  Y  S
      Y  G  W  V  S  G  N  M  M  D  G  F  S  C  P  L  C  C  T  V
       M  V  G  F  Q  V  I  *  W  M  V  F  L  V  H  C  V  V  Q  F

1381 TTATGACTCTAGTGAAGTTAAAGCCCAATCATCTGGTGTTATTCCTGAGAATCCTGTGTT 1440
     L  *  L  *  *  S  *  S  P  I  I  W  C  Y  S  *  E  S  C  V
      Y  D  S  S  E  V  K  A  Q  S  S  G  V  I  P  E  N  P  V  L
       M  T  L  V  K  L  K  P  N  H  L  V  L  F  L  R  I  L  C  Y

1441 ATTTACTAATAGTACTGATACTGTTAACCCTGATTCTTTTAATTTGTATGGTTATTCTGT 1500
     I  Y  *  *  Y  *  Y  C  *  P  *  F  F  *  F  V  W  L  F  C
      F  T  N  S  T  D  T  V  N  P  D  S  F  N  L  Y  G  Y  S  V
       L  L  I  V  L  I  L  L  T  L  I  L  L  I  C  M  V  I  L  L

1501 TACACCATTTGGTTCTTGTATATATTGGTCACCGCGTCCTGGATTGTGGATTCCTATCAT 1560
     Y  T  I  W  F  L  Y  I  L  V  T  A  S  W  I  V  D  S  Y  H
      T  P  F  G  S  C  I  Y  W  S  P  R  P  G  L  W  I  P  I  I
       H  H  L  V  L  V  Y  I  G  H  R  V  L  D  C  G  F  L  S  L

1561 TAAATCTTCAGTCAAGTCTTATGATGATTTGGTTTATTCAGGTGTAGTAGGTTGTAAATC 1620
     *  I  F  S  Q  V  L  *  *  F  G  L  F  R  C  S  R  L  *  I
      K  S  S  V  K  S  Y  D  D  L  V  Y  S  G  V  V  G  C  K  S
       N  L  Q  S  S  L  M  M  I  W  F  I  Q  V  *  *  V  V  N  L
```

FIG. 9 CONT.

```
1621 TATTGTTAAAGAAACTGCTCTTATTACTCATGCACTTTACTTAGATTATGTTCAATGTAA 1680
     Y  C  *  R  N  C  S  Y  Y  S  C  T  L  L  R  L  C  S  M  *
      I  V  K  E  T  A  L  I  T  H  A  L  Y  L  D  Y  V  Q  C  K
       L  L  K  K  L  L  L  L  L  M  H  F  T  *  I  M  F  N  V  S

1681 GTGTGGTAATCTTGAACAAAATCATATTCTTGGTGTTAATAATTCTTGGTGTAGGCAACT 1740
     V  W  *  S  *  T  K  S  Y  S  W  C  *  *  F  L  V  *  A  T
      C  G  N  L  E  Q  N  H  I  L  G  V  N  N  S  W  C  R  Q  L
       V  V  I  L  N  K  I  I  F  L  V  L  I  I  L  G  V  G  N  C

1741 GTTGCTTAATAGAGGTGATTATAATATGCTTTTAAAAAATATTGACTTGTTTGTTAAGCG 1800
     V  A  *  *  R  *  L  *  Y  A  F  K  K  Y  *  L  V  C  *  A
      L  L  N  R  G  D  Y  N  M  L  L  K  N  I  D  L  F  V  K  R
       C  L  I  E  V  I  I  I  C  F  *  K  I  L  T  C  L  L  S  V

1801 TCGTGCTGATTTTGCTTGCAAGTTTGCAGTTTGTGGAGATGGTTTTGTACCTTTTTTACT 1860
     S  C  *  F  C  L  Q  V  C  S  L  W  R  W  F  C  T  F  F  T
      R  A  D  F  A  C  K  F  A  V  C  G  D  G  F  V  P  F  L  L
       V  L  I  L  L  A  S  L  Q  F  V  E  M  V  L  Y  L  F  Y  *

1861 AGATGGTTTAATTCCCCGTAGTTATTATCTAATTCAGAGTGGTATTTTCTTTACATCTTT 1920
     R  W  F  N  S  P  *  L  L  S  N  S  E  W  Y  F  L  Y  I  F
      D  G  L  I  P  R  S  Y  Y  L  I  Q  S  G  I  F  F  T  S  L
       M  V  *  F  P  V  V  I  I  *  F  R  V  V  F  S  L  H  L  *

1921 GATGTCTCAATTTTCACAAGAAGTTTCTGATATGTGTTTAAAAATGTGTATTTTGTTTAT 1980
     D  V  S  I  F  T  R  S  F  *  Y  V  F  K  N  V  Y  F  V  Y
      M  S  Q  F  S  Q  E  V  S  D  M  C  L  K  M  C  I  L  F  M
       C  L  N  F  H  K  K  F  L  I  C  V  *  K  C  V  F  C  L  W

1981 GGACAGAGTTTCAGTTGCTACATTTTATATAGAGCATTATGTTAATAGGTTGGTTACTCA 2040
     G  Q  S  F  S  C  Y  I  L  Y  R  A  L  C  *  *  V  G  Y  S
      D  R  V  S  V  A  T  F  Y  I  E  H  Y  V  N  R  L  V  T  Q
       T  E  F  Q  L  L  H  F  I  *  S  I  M  L  I  G  W  L  L  N

2041 ATTTAAGTTATTGGGTACTACACTTGTTAATAAAATGGTTAATTGGTTTAATACCATGTT 2100
     I  *  V  I  G  Y  Y  T  C  *  *  N  G  *  L  V  *  Y  H  V
      F  K  L  L  G  T  T  L  V  N  K  M  V  N  W  F  N  T  M  L
       L  S  Y  W  V  L  H  L  L  I  K  W  L  I  G  L  I  P  C  *

2101 AGATGCTAGTGCACCTGCTACAGGCTGGCTTCTTTACCAATTATTGAATGGTCTTTTTGT 2160
     R  C  *  C  T  C  Y  R  L  A  S  L  P  I  I  E  W  S  F  C
      D  A  S  A  P  A  T  G  W  L  L  Y  Q  L  L  N  G  L  F  V
       M  L  V  H  L  L  Q  A  G  F  F  T  N  Y  *  M  V  F  L  *
```

FIG. 9 CONT.

```
2161 AGTATCTCAAGCCAACTTTAATTTTGTTGCTTTAATACCTGATTATGCTAAAATTTTAGT 2220
     S  I  S  S  Q  L  *  F  C  C  F  N  T  *  L  C  *  N  F  S
      V  S  Q  A  N  F  N  F  V  A  L  I  P  D  Y  A  K  I  L  V
       Y  L  K  P  T  L  I  L  L  L  *  Y  L  I  M  L  K  F  *  L

2221 TAATAAATTTTACACTTTTTTTAAGTTATTATTAGAGTGTGTTACAGTTGATGTTTTAAA 2280
     *  *  I  L  H  F  F  *  V  I  I  R  V  C  Y  S  *  C  F  K
      N  K  F  Y  T  F  F  K  L  L  L  E  C  V  T  V  D  V  L  K
       I  N  F  T  L  F  L  S  Y  Y  *  S  V  L  Q  L  M  F  *  K

2281 AGATATGCCTGTTCTTAAAACTATTAATGGTTTAGTTTGTATTGTAGGCAATAAGTTTTA 2340
     R  Y  A  C  S  *  N  Y  *  W  F  S  L  Y  C  R  Q  *  V  L
      D  M  P  V  L  K  T  I  N  G  L  V  C  I  V  G  N  K  F  Y
       I  C  L  F  L  K  L  L  M  V  *  F  V  L  *  A  I  S  F  I

2341 TAACGTTAGTACAGGGTTAATTCCTGGTTTTGTTTTACCATGTAATGCACAGGAACAACA 2400
     *  R  *  Y  R  V  N  S  W  F  C  F  T  M  *  C  T  G  T  T
      N  V  S  T  G  L  I  P  G  F  V  L  P  C  N  A  Q  E  Q  Q
       T  L  V  Q  G  *  F  L  V  L  F  Y  H  V  M  H  R  N  N  K

2401 AATTTATTTTTTTGAAGGCGTTGCAGAATCTGTTATAGTAGAAGATGATGTTATTGAGAA 2460
     N  L  F  F  *  R  R  C  R  I  C  Y  S  R  R  *  C  Y  *  E
      I  Y  F  F  E  G  V  A  E  S  V  I  V  E  D  D  V  I  E  N
       F  I  F  L  K  A  L  Q  N  L  L  *  *  K  M  M  L  L  R  M

2461 TGTCAAATCTTCTTTATCATCTTATGAGTATTGTCAACCACCTAAATCTGTAGAAAAAAT 2520
     C  Q  I  F  F  I  I  L  *  V  L  S  T  T  *  I  C  R  K  N
      V  K  S  S  L  S  S  Y  E  Y  C  Q  P  P  K  S  V  E  K  I
       S  N  L  L  Y  H  L  M  S  I  V  N  H  L  N  L  *  K  K  F

2521 TTGTATTATAGATAATATGTACATGGGTAAGTGTGGTGATAAATTTTTCCCTATTGTCAT 2580
     L  Y  Y  R  *  Y  V  H  G  *  V  W  *  *  I  F  P  Y  C  H
      C  I  I  D  N  M  Y  M  G  K  C  G  D  K  F  F  P  I  V  M
       V  L  *  I  I  C  T  W  V  S  V  V  I  N  F  S  L  L  S  *

2581 GAATGATAAAAATATTTGTCTTTTAGATCAGGCTTGGCGTTTTCCATGTGCAGGTAGAAA 2640
     E  *  *  K  Y  L  S  F  R  S  G  L  A  F  S  M  C  R  *  K
      N  D  K  N  I  C  L  L  D  Q  A  W  R  F  P  C  A  G  R  K
       M  I  K  I  F  V  F  *  I  R  L  G  V  F  H  V  Q  V  E  K

2641 AGTTAATTTTAACGAGAAACCTGTTGTTATGGAGATTCCGTCTTTGATGACAGTTAAGGT 2700
     S  *  F  *  R  E  T  C  C  Y  G  D  S  V  F  D  D  S  *  G
      V  N  F  N  E  K  P  V  V  M  E  I  P  S  L  M  T  V  K  V
       L  I  L  T  R  N  L  L  L  W  R  F  R  L  *  *  Q  L  R  L
```

FIG. 9 CONT.

```
2701 TATGTTTGATTTAGATTCTACTTTTGATGATATTTTAGGTAAAGTTTGTTCAGAATTTGA 2760
     Y  V  *  F  R  F  Y  F  *  *  Y  F  R  *  S  L  F  R  I  *
      M  F  D  L  D  S  T  F  D  D  I  L  G  K  V  C  S  E  F  E
       C  L  I  *  I  L  L  L  M  I  F  *  V  K  F  V  Q  N  L  K

2761 AGTAGAAAAGGGTGTTACTGTAGATGATTTTGTCGCTGTTGTTTGTGATGCTATAGAGAA 2820
     S  R  K  G  C  Y  C  R  *  F  C  R  C  C  L  *  C  Y  R  E
      V  E  K  G  V  T  V  D  D  F  V  A  V  V  C  D  A  I  E  N
       *  K  R  V  L  L  *  M  I  L  S  L  L  F  V  M  L  *  R  M

2821 TGCTTTAAACTCTTGTAAAGATCATCCAGTGGTTGGTTATCAAGTTCGTGCATTTTTAAA 2880
     C  F  K  L  L  *  R  S  S  S  G  W  L  S  S  S  C  I  F  K
      A  L  N  S  C  K  D  H  P  V  V  G  Y  Q  V  R  A  F  L  N
       L  *  T  L  V  K  I  I  Q  W  L  V  I  K  F  V  H  F  *  I

2881 TAAACTTAATGAGAACGTTGTTTATTTATTTGATGAGGCTGGTGATGAAGCAATGGCCTC 2940
     *  T  *  *  E  R  C  L  F  I  *  *  G  W  *  *  S  N  G  L
      K  L  N  E  N  V  V  Y  L  F  D  E  A  G  D  E  A  M  A  S
       N  L  M  R  T  L  F  I  Y  L  M  R  L  V  M  K  Q  W  P  L

2941 TCGTATGTATTGTACTTTTGCTATTGAGGATGTTGAAGACGTTATCAGTAGTGAAGCTGT 3000
     S  Y  V  L  Y  F  C  Y  *  G  C  *  R  R  Y  Q  *  *  S  C
      R  M  Y  C  T  F  A  I  E  D  V  E  D  V  I  S  S  E  A  V
       V  C  I  V  L  L  L  L  R  M  L  K  T  L  S  V  V  K  L  L

3001 TGAAGATACTATTGATGGTGTCGTTGAAGACACTATTAATGATGATGAAGATGTTGTTAC 3060
     *  R  Y  Y  *  W  C  R  *  R  H  Y  *  *  *  *  R  C  C  Y
      E  D  T  I  D  G  V  V  E  D  T  I  N  D  D  E  D  V  V  T
       K  I  L  L  M  V  S  L  K  T  L  L  M  M  M  K  M  L  L  L

3061 TGGTGACAATGACGATGAAGATGTTGTTACTGGTGACAATGACGATGAAGATGTTGTTAC 3120
     W  *  Q  *  R  *  R  C  C  Y  W  *  Q  *  R  *  R  C  C  Y
      G  D  N  D  D  E  D  V  V  T  G  D  N  D  D  E  D  V  V  T
       V  T  M  T  M  K  M  L  L  L  V  T  M  T  M  K  M  L  L  L

3121 TGGTGACAATGACGATGAAGATGTTGTTACTGGTGACAATGACGATGAAGATGTTGTTAC 3180
     W  *  Q  *  R  *  R  C  C  Y  W  *  Q  *  R  *  R  C  C  Y
      G  D  N  D  D  E  D  V  V  T  G  D  N  D  D  E  D  V  V  T
       V  T  M  T  M  K  M  L  L  L  V  T  M  T  M  K  M  L  L  L

3181 TGGTGATAATGACGATGAAGATGTTGTTACTGGTGACAATGACGATGAAGATGTTGTTAC 3240
     W  *  *  *  R  *  R  C  C  Y  W  *  Q  *  R  *  R  C  C  Y
      G  D  N  D  D  E  D  V  V  T  G  D  N  D  D  E  D  V  V  T
       V  I  M  T  M  K  M  L  L  L  V  T  M  T  M  K  M  L  L  L
```

FIG. 9 CONT.

```
3241 TGGTGACAATGACGATGAAGATGTTGTTACTGGTGACAATGACGATGAAGATGTTGTTAC 3300
     W  *  Q  *  R  *  R  C  C  Y  W  *  Q  *  R  *  R  C  C  Y
      G  D  N  D  D  E  D  V  V  T  G  D  N  D  D  E  D  V  V  T
       V  T  M  T  M  K  M  L  L  L  V  T  M  T  M  K  M  L  L  L

3301 TGGTGACAATGACGATGAAGATGTTGTTACTGGTGACAATGACGATGAAGATGTTGTTAC 3360
     W  *  Q  *  R  *  R  C  C  Y  W  *  Q  *  R  *  R  C  C  Y
      G  D  N  D  D  E  D  V  V  T  G  D  N  D  D  E  D  V  V  T
       V  T  M  T  M  K  M  L  L  L  V  T  M  T  M  K  M  L  L  L

3361 TGGTGACAATGACGATGAAGAGATTGTTACTGGTGACAATGATGACCAAATTGTTGTTAC 3420
     W  *  Q  *  R  *  R  D  C  Y  W  *  Q  *  *  P  N  C  C  Y
      G  D  N  D  D  E  E  I  V  T  G  D  N  D  D  Q  I  V  V  T
       V  T  M  T  M  K  R  L  L  L  V  T  M  M  T  K  L  L  L  L

3421 TGGTGATGATGTAGATGATATTGAAAGTGTCTATGATTTTGATACTTATAAAGCTCTTTT 3480
     W  *  *  C  R  *  Y  *  K  C  L  *  F  *  Y  L  *  S  S  F
      G  D  D  V  D  D  I  E  S  V  Y  D  F  D  T  Y  K  A  L  L
       V  M  M  *  M  I  L  K  V  S  M  I  L  I  L  I  K  L  F  *

3481 AGTTTTTAATGATGTCTATAATGATGCTTTGTTTGTTAGTTATGGTTCTAGTGTTGAAAC 3540
     S  F  *  *  C  L  *  *  C  F  V  C  *  L  W  F  *  C  *  N
      V  F  N  D  V  Y  N  D  A  L  F  V  S  Y  G  S  S  V  E  T
       F  L  M  M  S  I  M  M  L  C  L  L  V  M  V  L  V  L  K  Q

3541 AGAAACATATTTTAAAGTTAATGGTTTATGGTCACCTACTATTACACATACTAACTGTTG 3600
     R  N  I  F  *  S  *  W  F  M  V  T  Y  Y  Y  T  Y  *  L  L
      E  T  Y  F  K  V  N  G  L  W  S  P  T  I  T  H  T  N  C  W
       K  H  I  L  K  L  M  V  Y  G  H  L  L  L  H  I  L  T  V  G

3601 GTTGCGTTCTGTGTTACTTGTAATGCAGAAATTACCTTTTAAGTTTAAGGATTTAGCTAT 3660
     V  A  F  C  V  T  C  N  A  E  I  T  F  *  V  *  G  F  S  Y
      L  R  S  V  L  L  V  M  Q  K  L  P  F  K  F  K  D  L  A  I
       C  V  L  C  Y  L  *  C  R  N  Y  L  L  S  L  R  I  *  L  L

3661 TGAAAATATGTGGTTATCTTATAAGGTGGGTTATAATCAAAGTTTTGTTGATTATTTACT 3720
     *  K  Y  V  V  I  L  *  G  G  L  *  S  K  F  C  *  L  F  T
      E  N  M  W  L  S  Y  K  V  G  Y  N  Q  S  F  V  D  Y  L  L
       K  I  C  G  Y  L  I  R  W  V  I  I  K  V  L  L  I  I  Y  *

3721 GACCACTATTCCTAAAGCTATTGTTTTGCCTCAAGGTGGTTATGTAGCTGACTTTGCTTA 3780
     D  H  Y  S  *  S  Y  C  F  A  S  R  W  L  C  S  *  L  C  L
      T  T  I  P  K  A  I  V  L  P  Q  G  G  Y  V  A  D  F  A  Y
       P  L  F  L  K  L  L  F  C  L  K  V  V  M  *  L  T  L  L  I
```

FIG. 9 CONT.

```
3781 TTGGTTTTTAAACCAGTTTGATATTAATGCGTATGCTAATTGGTGTTGTTTAAAATGTGG 3840
     L  V  F  K  P  V  *  Y  *  C  V  C  *  L  V  L  F  K  M  W
      W  F  L  N  Q  F  D  I  N  A  Y  A  N  W  C  C  L  K  C  G
       G  F  *  T  S  L  I  L  M  R  M  L  I  G  V  V  *  N  V  V

3841 TTTTTCTTTTGATTTAAATGGTTTGGATGCTGTGTTTTTTTATGGAGATATTGTGTCTCA 3900
     F  F  F  *  F  K  W  F  G  C  C  V  F  L  W  R  Y  C  V  S
      F  S  F  D  L  N  G  L  D  A  V  F  F  Y  G  D  I  V  S  H
       F  L  L  I  *  M  V  W  M  L  C  F  F  M  E  I  L  C  L  M

3901 TGTTTGTAAGTGTGGACATAATATGACTCTAATAGCAGCGGACTTACCTTGTACATTACA 3960
     C  L  *  V  W  T  *  Y  D  S  N  S  S  G  L  T  L  Y  I  T
      V  C  K  C  G  H  N  M  T  L  I  A  A  D  L  P  C  T  L  H
       F  V  S  V  D  I  I  *  L  *  *  Q  R  T  Y  L  V  H  Y  I

3961 TTTTTCATTATTTGATGACAATTTTTGTGCTTTTTGCACCCCTAAAAAAATTTTTATTGC 4020
     F  F  I  I  *  *  Q  F  L  C  F  L  H  P  *  K  N  F  Y  C
      F  S  L  F  D  D  N  F  C  A  F  C  T  P  K  K  I  F  I  A
       F  H  Y  L  M  T  I  F  V  L  F  A  P  L  K  K  F  L  L  L

4021 TGCATGTGCTGTGGATGTAAACGTTTGTCATTCTGTAGCTGTTATAGGTGATGAACAAAT 4080
     C  M  C  C  G  C  K  R  L  S  F  C  S  C  Y  R  *  *  T  N
      A  C  A  V  D  V  N  V  C  H  S  V  A  V  I  G  D  E  Q  I
       H  V  L  W  M  *  T  F  V  I  L  *  L  L  *  V  M  N  K  *

4081 AGATGGTAAGTTTGTTACTAAATTTAGTGGTGATAAATTTGATTTTATAGTAGGTTATGG 4140
     R  W  *  V  C  Y  *  I  *  W  *  *  I  *  F  Y  S  R  L  W
      D  G  K  F  V  T  K  F  S  G  D  K  F  D  F  I  V  G  Y  G
       M  V  S  L  L  L  N  L  V  V  I  N  L  I  L  *  *  V  M  E

4141 AATGTCATTTAGTATGTCTTCTTTTGAGTTAGCTCAATTGTATGGTTTGTGTATAACACC 4200
     N  V  I  *  Y  V  F  F  *  V  S  S  I  V  W  F  V  Y  N  T
      M  S  F  S  M  S  S  F  E  L  A  Q  L  Y  G  L  C  I  T  P
       C  H  L  V  C  L  L  L  S  *  L  N  C  M  V  C  V  *  H  L

4201 TAATGTATGTTTTGTTAAAGGTGATATTATAAATGTTGCTAGACTTGTTAAAGCTGATGT 4260
     *  C  M  F  C  *  R  *  Y  Y  K  C  C  *  T  C  *  S  *  C
      N  V  C  F  V  K  G  D  I  I  N  V  A  R  L  V  K  A  D  V
       M  Y  V  L  L  K  V  I  L  *  M  L  L  D  L  L  K  L  M  L

4261 TATTGTTAACCCTGCTAATGGGCATATGCTCCATGGTGGTGGAGTTGCAAAAGCTATAGC 4320
     Y  C  *  P  C  *  W  A  Y  A  P  W  W  W  S  C  K  S  Y  S
      I  V  N  P  A  N  G  H  M  L  H  G  G  G  V  A  K  A  I  A
       L  L  T  L  L  M  G  I  C  S  M  V  V  E  L  Q  K  L  *  L
```

FIG. 9 CONT.

```
4321 TGTAGCTGCAGGTAAAAAATTTTCTAAAGAAACTGCTGCTATGGTTAAATCTAAAGGTGT 4380
     C  S  C  R  *  K  I  F  *  R  N  C  C  Y  G  *  I  *  R  C
      V  A  A  G  K  K  F  S  K  E  T  A  A  M  V  K  S  K  G  V
       *  L  Q  V  K  N  F  L  K  K  L  L  L  W  L  N  L  K  V  F

4381 TTGCCAAGTAGGAGATTGTTATGTTTCTACCGGTGGTAAATTATGTAAAACAATTCTTAA 4440
     L  P  S  R  R  L  L  C  F  Y  R  W  *  I  M  *  N  N  S  *
      C  Q  V  G  D  C  Y  V  S  T  G  G  K  L  C  K  T  I  L  N
       A  K  *  E  I  V  M  F  L  P  V  V  N  Y  V  K  Q  F  L  I

4441 TATTGTAGGTCCTGATGCTAGACAAGATGGAAGACAATCTTATGTTTTGTTAGCACGTGC 4500
     Y  C  R  S  *  C  *  T  R  W  K  T  I  L  C  F  V  S  T  C
      I  V  G  P  D  A  R  Q  D  G  R  Q  S  Y  V  L  L  A  R  A
       L  *  V  L  M  L  D  K  M  E  D  N  L  M  F  C  *  H  V  L

4501 TTATAAGCATCTTAATAATTATGATTGTTGTTTGTCTACTCTCATATCGGCTGGTATATT 4560
     L  *  A  S  *  *  L  *  L  L  F  V  Y  S  H  I  G  W  Y  I
      Y  K  H  L  N  N  Y  D  C  C  L  S  T  L  I  S  A  G  I  F
       I  S  I  L  I  I  M  I  V  V  C  L  L  S  Y  R  L  V  Y  L

4561 TAGTGTTCCTGCTGATGTGTCATTAACTTACCTTCTAGGTGTTGTTGATAAACAAGTTAT 4620
     *  C  S  C  *  C  V  I  N  L  P  S  R  C  C  *  *  T  S  Y
      S  V  P  A  D  V  S  L  T  Y  L  L  G  V  V  D  K  Q  V  I
       V  F  L  L  M  C  H  *  L  T  F  *  V  L  L  I  N  K  L  S

4621 CCTTGTTAGTAATAATAAAGAAGATTTTGATATTATTCAAAAATGTCAAATTACTTCAGT 4680
     P  C  *  *  *  *  R  R  F  *  Y  Y  S  K  M  S  N  Y  F  S
      L  V  S  N  N  K  E  D  F  D  I  I  Q  K  C  Q  I  T  S  V
       L  L  V  I  I  K  K  I  L  I  L  F  K  N  V  K  L  L  Q  L

4681 TGTTGGTACTAAAGCATTGGCTGTTAGATTAACTGCTAATGTAGGCCGTGTTATTAAATT 4740
     C  W  Y  *  S  I  G  C  *  I  N  C  *  C  R  P  C  Y  *  I
      V  G  T  K  A  L  A  V  R  L  T  A  N  V  G  R  V  I  K  F
       L  V  L  K  H  W  L  L  D  *  L  L  M  *  A  V  L  L  N  L

4741 TGAGACAGATGCATACAAACTTTTCTTGAGTGGTGATGATTGTTTTGTTTCAAATTCTTC 4800
     *  D  R  C  I  Q  T  F  L  E  W  *  *  L  F  C  F  K  F  F
      E  T  D  A  Y  K  L  F  L  S  G  D  D  C  F  V  S  N  S  S
       R  Q  M  H  T  N  F  S  *  V  V  M  I  V  L  F  Q  I  L  L

4801 TGTTATACAAGAAGTTTTATTGCTTCGTCATGATATACAATTGAATAATGACGTTCGTGA 4860
     C  Y  T  R  S  F  I  A  S  S  *  Y  T  I  E  *  *  R  S  *
      V  I  Q  E  V  L  L  L  R  H  D  I  Q  L  N  N  D  V  R  D
       L  Y  K  K  F  Y  C  F  V  M  I  Y  N  *  I  M  T  F  V  I
```

FIG. 9 CONT.

```
4861 TTATTTGTTGTCTAAGATGACTAGTCTTCCCAAAGATTGGCGTCTTATCAATAAATTTGA 4920
      L  F  V  V  *  D  D  *  S  S  Q  R  L  A  S  Y  Q  *  I  *
       Y  L  L  S  K  M  T  S  L  P  K  D  W  R  L  I  N  K  F  D
        I  C  C  L  R  *  L  V  F  P  K  I  G  V  L  S  I  N  L  M

4921 TGTTATTAACGGTGTTAAAACTGTTAAGTACTTTGAGTGTCCTAATTCTATTTATATATG 4980
      C  Y  *  R  C  *  N  C  *  V  L  *  V  S  *  F  Y  L  Y  M
       V  I  N  G  V  K  T  V  K  Y  F  E  C  P  N  S  I  Y  I  C
        L  L  T  V  L  K  L  L  S  T  L  S  V  L  I  L  F  I  Y  V

4981 TAGTCAGGGTAAAGACTTTGGTTATGTATGTGATGGTTCTTTTTATAAAGCAACTGTTAA 5040
      *  S  G  *  R  L  W  L  C  M  *  W  F  F  L  *  S  N  C  *
       S  Q  G  K  D  F  G  Y  V  C  D  G  S  F  Y  K  A  T  V  N
        V  R  V  K  T  L  V  M  Y  V  M  V  L  F  I  K  Q  L  L  I

5041 TCAAGTTTGTGTGTTATTAGCTAAGAAGATAGATGTTTTGCTTACTGTAGATGGTGTTAA 5100
      S  S  L  C  V  I  S  *  E  D  R  C  F  A  Y  C  R  W  C  *
       Q  V  C  V  L  L  A  K  K  I  D  V  L  L  T  V  D  G  V  N
        K  F  V  C  Y  *  L  R  R  *  M  F  C  L  L  *  M  V  L  I

5101 TTTTAAATCTATTTCTCTTACTGTAGGTGAAGTTTTTGGTAAAATACTTGGTAATGTTTT 5160
      F  *  I  Y  F  S  Y  C  R  *  S  F  W  *  N  T  W  *  C  F
       F  K  S  I  S  L  T  V  G  E  V  F  G  K  I  L  G  N  V  F
        L  N  L  F  L  L  L  *  V  K  F  L  V  K  Y  L  V  M  F  S

5161 CTGTGATGGCATTGATGTTACTAAGTTAAAGTGTAGTGATTTTTATGCCGATAAAATTTT 5220
      L  *  W  H  *  C  Y  *  V  K  V  *  *  F  L  C  R  *  N  F
       C  D  G  I  D  V  T  K  L  K  C  S  D  F  Y  A  D  K  I  L
        V  M  A  L  M  L  L  S  *  S  V  V  I  F  M  P  I  K  F  Y

5221 ATATCAGTATGAAAATTTGTCTTTAGCTGATATTTCTGCTGTACAAAGTTCATTTGGGTT 5280
      I  S  V  *  K  F  V  F  S  *  Y  F  C  C  T  K  F  I  W  V
       Y  Q  Y  E  N  L  S  L  A  D  I  S  A  V  Q  S  S  F  G  F
        I  S  M  K  I  C  L  *  L  I  F  L  L  Y  K  V  H  L  G  L

5281 TGATCAGCAACAATTGCTTGCTTACTATAATTTTTTAACAGTATGTAAATGGTCTGTAGT 5340
      *  S  A  T  I  A  C  L  L  *  F  F  N  S  M  *  M  V  C  S
       D  Q  Q  Q  L  L  A  Y  Y  N  F  L  T  V  C  K  W  S  V  V
        I  S  N  N  C  L  L  T  I  I  F  *  Q  Y  V  N  G  L  *  L

5341 TGTTAACGGTCCATTTTTTTCTTTTGAACAGTCTCATAATAATTGTTATGTGAATGTAGC 5400
      C  *  R  S  I  F  F  F  *  T  V  S  *  *  L  L  C  E  C  S
       V  N  G  P  F  F  S  F  E  Q  S  H  N  N  C  Y  V  N  V  A
        L  T  V  H  F  F  L  L  N  S  L  I  I  I  V  M  *  M  *  L
```

FIG. 9 CONT.

```
5401 TTGTCTTATGTTGCAGCATATTAATCTTAAATTTAATAAATGGCAGTGGCAGGAAGCATG 5460
     L  S  Y  V  A  A  Y  *  S  *  I  *  *  M  A  V  A  G  S  M
      C  L  M  L  Q  H  I  N  L  K  F  N  K  W  Q  W  Q  E  A  W
       V  L  C  C  S  I  L  I  L  N  L  I  N  G  S  G  R  K  H  G

5461 GTATGAATTTCGTGCTGGCAGACCACATAGGTTAGTTGCTCTTGTTTTAGCTAAAGGTCA 5520
     V  *  I  S  C  W  Q  T  T  *  V  S  C  S  C  F  S  *  R  S
      Y  E  F  R  A  G  R  P  H  R  L  V  A  L  V  L  A  K  G  H
       M  N  F  V  L  A  D  H  I  G  *  L  L  L  F  *  L  K  V  I

5521 TTTTAAATTTGATGAACCATCAGATGCTACTGATTTTATTCGTGTTGTTTTGAAACAAGC 5580
     F  *  I  *  *  T  I  R  C  Y  *  F  Y  S  C  C  F  E  T  S
      F  K  F  D  E  P  S  D  A  T  D  F  I  R  V  V  L  K  Q  A
       L  N  L  M  N  H  Q  M  L  L  I  L  F  V  L  F  *  N  K  L

5581 TGATTTATCAGGTGCAATTTGTGAATTAGAACTTATTTGTGATTGTGGTATTAAACAAGA 5640
     *  F  I  R  C  N  L  *  I  R  T  Y  L  *  L  W  Y  *  T  R
      D  L  S  G  A  I  C  E  L  E  L  I  C  D  C  G  I  K  Q  E
       I  Y  Q  V  Q  F  V  N  *  N  L  F  V  I  V  V  L  N  K  K

5641 AAGTCGTGTTGGTGTTGATGCTGTTATGCATTTTGGTACATTAGCAAAGACTGATCTTTT 5700
     K  S  C  W  C  *  C  C  Y  A  F  W  Y  I  S  K  D  *  S  F
      S  R  V  G  V  D  A  V  M  H  F  G  T  L  A  K  T  D  L  F
       V  V  L  V  L  M  L  L  C  I  L  V  H  *  Q  R  L  I  F  L

5701 TAATGGTTATAAGATTGGCTGTAATTGTGCAGGTAGAATTGTCCATTGTACTAAATTGAA 5760
     *  W  L  *  D  W  L  *  L  C  R  *  N  C  P  L  Y  *  I  E
      N  G  Y  K  I  G  C  N  C  A  G  R  I  V  H  C  T  K  L  N
       M  V  I  R  L  A  V  I  V  Q  V  E  L  S  I  V  L  N  *  M

5761 TGTACCATTTTTGATTTGTTCTAATACTCCTCTGAGTAAGGATTTACCTGATGATGTTGT 5820
     C  T  I  F  D  L  F  *  Y  S  S  E  *  G  F  T  *  *  C  C
      V  P  F  L  I  C  S  N  T  P  L  S  K  D  L  P  D  D  V  V
       Y  H  F  *  F  V  L  I  L  L  *  V  R  I  Y  L  M  M  L  L

5821 TGCAGCTAACATGTTTATGGGTGTAGGTGTAGGCCATTATACACATTTGAAATGTGGTTC 5880
     C  S  *  H  V  Y  G  C  R  C  R  P  L  Y  T  F  E  M  W  F
      A  A  N  M  F  M  G  V  G  V  G  H  Y  T  H  L  K  C  G  S
       Q  L  T  C  L  W  V  *  V  *  A  I  I  H  I  *  N  V  V  H

5881 ACCTTACCAACATTATGATGCTTGTAGTGTTAAAAAATATACAGGTGTTAGTGGTTGTTT 5940
     T  L  P  T  L  *  C  L  *  C  *  K  I  Y  R  C  *  W  L  F
      P  Y  Q  H  Y  D  A  C  S  V  K  K  Y  T  G  V  S  G  C  L
       L  T  N  I  M  M  L  V  V  L  K  N  I  Q  V  L  V  V  V  *
```

FIG. 9 CONT.

```
5941 AACTGACTGCTTGTATCTTAAAAATTTAACCCAGACTTTTACATCTATGTTGACTAATTA 6000
     N  *  L  L  V  S  *  K  F  N  P  D  F  Y  I  Y  V  D  *  L
      T  D  C  L  Y  L  K  N  L  T  Q  T  F  T  S  M  L  T  N  Y
       L  T  A  C  I  L  K  I  *  P  R  L  L  H  L  C  *  L  I  I

6001 TTTTTTGGATGATGTTGAAATGGTTGCTTATAACCCTGATCTTTCACAATATTATTGTGA 6060
     F  F  G  *  C  *  N  G  C  L  *  P  *  S  F  T  I  L  L  *
      F  L  D  D  V  E  M  V  A  Y  N  P  D  L  S  Q  Y  Y  C  D
       F  W  M  M  L  K  W  L  L  I  T  L  I  F  H  N  I  I  V  I

6061 TAATGGTAAGTATTATACAAAACCTATTATAAAGGCTCAGTTTAAACCATTTGCTAAAGT 6120
     *  W  *  V  L  Y  K  T  Y  Y  K  G  S  V  *  T  I  C  *  S
      N  G  K  Y  Y  T  K  P  I  I  K  A  Q  F  K  P  F  A  K  V
       M  V  S  I  I  Q  N  L  L  *  R  L  S  L  N  H  L  L  K  L

6121 TGACGGTGTTTATACTAACTTTAAGTTAGTTGGACATGATATTTGTGCTCAATTGAATGA 6180
     *  R  C  L  Y  *  L  *  V  S  W  T  *  Y  L  C  S  I  E  *
      D  G  V  Y  T  N  F  K  L  V  G  H  D  I  C  A  Q  L  N  D
       T  V  F  I  L  T  L  S  *  L  D  M  I  F  V  L  N  *  M  I

6181 TAAGTTAGGTTTTAATGTAGATTTGCCGTTTGTTGAGTACAAAGTAACAGTCTGGCCTGT 6240
     *  V  R  F  *  C  R  F  A  V  C  *  V  Q  S  N  S  L  A  C
      K  L  G  F  N  V  D  L  P  F  V  E  Y  K  V  T  V  W  P  V
       S  *  V  L  M  *  I  C  R  L  L  S  T  K  *  Q  S  G  L  *

6241 AGCTACTGGTGATGTTGTTTTGGCATCTGATGATTTATATGTTAAACGTTATTTTAAAGG 6300
     S  Y  W  *  C  C  F  G  I  *  *  F  I  C  *  T  L  F  *  R
      A  T  G  D  V  V  L  A  S  D  D  L  Y  V  K  R  Y  F  K  G
       L  L  V  M  L  F  W  H  L  M  I  Y  M  L  N  V  I  L  K  D

6301 ATGTGAAACTTTTGGTAAGCCTGTTATTTGGCTTTGTCATGATGAAGCATCATTGAATTC 6360
     M  *  N  F  W  *  A  C  Y  L  A  L  S  *  *  S  I  I  E  F
      C  E  T  F  G  K  P  V  I  W  L  C  H  D  E  A  S  L  N  S
       V  K  L  L  V  S  L  L  F  G  F  V  M  M  K  H  H  *  I  L

6361 TCTTACTTATTTTAATAAACCTAGTTTTAAATCTGAAAATAGATATAGTGTTTTGTCTGT 6420
     S  Y  L  F  *  *  T  *  F  *  I  *  K  *  I  *  C  F  V  C
      L  T  Y  F  N  K  P  S  F  K  S  E  N  R  Y  S  V  L  S  V
       L  L  I  L  I  N  L  V  L  N  L  K  I  D  I  V  F  C  L  L

6421 TGATTCTGTATCTGAGGAGTCACAAGGTAATGTGGTTACTTCTGTTATGGAATCGCAGAT 6480
     *  F  C  I  *  G  V  T  R  *  C  G  Y  F  C  Y  G  I  A  D
      D  S  V  S  E  E  S  Q  G  N  V  V  T  S  V  M  E  S  Q  I
       I  L  Y  L  R  S  H  K  V  M  W  L  L  L  L  W  N  R  R  L
```

FIG. 9 CONT.

```
6481 TAGTACTAAAGAGGTTAAGTTAAAGGGTGTTAGAAAGACTGTTAAAATAGAAGATGCTAT 6540
     * Y * R G * V K G C * K D C * N R R C Y
      S T K E V K L K G V R K T V K I E D A I
       V L K R L S * R V L E R L L K * K M L L

6541 TATTGTTAATGATGAAAATAGTTCTATTAAGGTTGTTAAAAGTTTATCTTTAGTTGATGT 6600
     Y C * * * K * F Y * G C * K F I F S * C
      I V N D E N S S I K V V K S L S L V D V
       L L M M K I V L L R L L K V Y L * L M F

6601 TTGGGATATGTATTTGACAGGTTGTGATTATGTTGTTTGGGTTGCTAATGAATTGTCACG 6660
     L G Y V F D R L * L C C L G C * * I V T
      W D M Y L T G C D Y V V W V A N E L S R
       G I C I * Q V V I M L F G L L M N C H A

6661 CCTAGTTAAATCACCAACAGTTAGGGAATATATACGATATGGTATTAAACCTATTACTAT 6720
     P S * I T N S * G I Y T I W Y * T Y Y Y
      L V K S P T V R E Y I R Y G I K P I T I
       * L N H Q Q L G N I Y D M V L N L L L Y

6721 ACCTATAGATTTGTTATGTTTAAGAGATGATAATCAAACTCTTTTAGTTCCTAAAATTTT 6780
     T Y R F V M F K R * * S N S F S S * N F
      P I D L L C L R D D N Q T L L V P K I F
       L * I C Y V * E M I I K L F * F L K F L

6781 TAAAGCAAGAGCTATAGAATTTTATGGTTTTTTGAAGTGGTTGTTTATTTATGTTTTTAG 6840
     * S K S Y R I L W F F E V V V Y L C F *
      K A R A I E F Y G F L K W L F I Y V F S
       K Q E L * N F M V F * S G C L F M F L V

6841 TTTATTACATTTTACAAATGATAAAACCATTTTTTATACTACAGAAATAGCTTCTAAGTT 6900
     F I T F Y K * * N H F L Y Y R N S F * V
      L L H F T N D K T I F Y T T E I A S K F
       Y Y I L Q M I K P F F I L Q K * L L S L

6901 TACTTTTAATTTGTTTTGTTTGGCTCTTAAAAATGCTTTTCAGACATTTAGATGGAGTAT 6960
     Y F * F V L F G S * K C F S D I * M E Y
      T F N L F C L A L K N A F Q T F R W S I
       L L I C F V W L L K M L F R H L D G V Y

6961 ATTTATAAAAGGTTTTCTTGTTGTAGCCACTGTGTTTTTGTTTTGGTTTAATTTTTTGTA 7020
     I Y K R F S C C S H C V F V L V * F F V
      F I K G F L V V A T V F L F W F N F L Y
       L * K V F L L * P L C F C F G L I F C I
```

FIG. 9 CONT.

```
7021 TATAAATGTTATTTTTAGTGATTTTTATCTTCCTAATATTAGTGTTTTTCCTATTTTTGT 7080
     Y  K  C  Y  F  *  *  F  L  S  S  *  Y  *  C  F  S  Y  F  C
      I  N  V  I  F  S  D  F  Y  L  P  N  I  S  V  F  P  I  F  V
       *  M  L  F  L  V  I  F  I  F  L  I  L  V  F  F  L  F  L  W

7081 GGGAAGAATTGTTATGTGGATAAAGGCTACTTTTGGTTTGGTTACAATTTGTGATTTTTA 7140
     G  K  N  C  Y  V  D  K  G  Y  F  W  F  G  Y  N  L  *  F  L
      G  R  I  V  M  W  I  K  A  T  F  G  L  V  T  I  C  D  F  Y
       E  E  L  L  C  G  *  R  L  L  L  V  W  L  Q  F  V  I  F  I

7141 TTCTAAGTTAGGTGTAGGTTTTACAAGTCATTTTTGTAATGGTAGTTTTATATGTGAATT 7200
     F  *  V  R  C  R  F  Y  K  S  F  L  *  W  *  F  Y  M  *  I
      S  K  L  G  V  G  F  T  S  H  F  C  N  G  S  F  I  C  E  L
       L  S  *  V  *  V  L  Q  V  I  F  V  M  V  V  L  Y  V  N  C

7201 GTGTTATTCTGGTTTTGATATGTTGGATACATATGCAGCTATAGATTTTGTTCAGTATGA 7260
     V  L  F  W  F  *  Y  V  G  Y  I  C  S  Y  R  F  C  S  V  *
      C  Y  S  G  F  D  M  L  D  T  Y  A  A  I  D  F  V  Q  Y  E
       V  I  L  V  L  I  C  W  I  H  M  Q  L  *  I  L  F  S  M  K

7261 AGTAGATAGACGTGTTTTATTTGATTATGTTAGTTTAGTCAAATTAATTGTTGAACTCGT 7320
     S  R  *  T  C  F  I  *  L  C  *  F  S  Q  I  N  C  *  T  R
      V  D  R  R  V  L  F  D  Y  V  S  L  V  K  L  I  V  E  L  V
       *  I  D  V  F  Y  L  I  M  L  V  *  S  N  *  L  L  N  S  L

7321 TATTGGTTATTCATTATATACAGTATGGTTTTATCCATTATTTTGTCTTATTGGTTTACA 7380
     Y  W  L  F  I  I  Y  S  M  V  L  S  I  I  L  S  Y  W  F  T
      I  G  Y  S  L  Y  T  V  W  F  Y  P  L  F  C  L  I  G  L  Q
       L  V  I  H  Y  I  Q  Y  G  F  I  H  Y  F  V  L  L  V  Y  N

7381 ATTATTTACTACATGGTTGCCTGATTTGTTTATGTTAGAAACTATGCATTGGTTGATTAG 7440
     I  I  Y  Y  M  V  A  *  F  V  Y  V  R  N  Y  A  L  V  D  *
      L  F  T  T  W  L  P  D  L  F  M  L  E  T  M  H  W  L  I  R
       Y  L  L  H  G  C  L  I  C  L  C  *  K  L  C  I  G  *  L  D

7441 ATTTATTGTATTTGTAGCTAATATGTTACCTGCTTTTGTCTTGTTGCGGTTTTATATAGT 7500
     I  Y  C  I  C  S  *  Y  V  T  C  F  C  L  V  A  V  L  Y  S
      F  I  V  F  V  A  N  M  L  P  A  F  V  L  L  R  F  Y  I  V
       L  L  Y  L  *  L  I  C  Y  L  L  L  S  C  C  G  F  I  *  L

7501 TGTTACTGCTATGTATAAAGTAGTTGGTTTTATTAGGCATATTGTTTATGGTTGTAATAA 7560
     C  Y  C  Y  V  *  S  S  W  F  Y  *  A  Y  C  L  W  L  *  *
      V  T  A  M  Y  K  V  V  G  F  I  R  H  I  V  Y  G  C  N  K
       L  L  L  C  I  K  *  L  V  L  L  G  I  L  F  M  V  V  I  K
```

FIG. 9 CONT.

```
7561 AGCTGGTTGTTTGTTTTGTTATAAACGAAATTGTAGTGTTCGTGTTAAGTGTAGTACTAT 7620
     S  W  L  F  V  L  L  *  T  K  L  *  C  S  C  *  V  *  Y  Y
      A  G  C  L  F  C  Y  K  R  N  C  S  V  R  V  K  C  S  T  I
       L  V  V  C  F  V  I  N  E  I  V  V  F  V  L  S  V  V  L  L

7621 TGTTGGTGGTGTAATTCGTTATTATGATATTACTGCTAATGGTGGTACTGGTTTTTGTGT 7680
     C  W  W  C  N  S  L  L  *  Y  Y  C  *  W  W  Y  W  F  L  C
      V  G  G  V  I  R  Y  Y  D  I  T  A  N  G  G  T  G  F  C  V
       L  V  V  *  F  V  I  M  I  L  L  L  M  V  V  L  V  F  V  L

7681 TAAACATCAATGGAATTGTTTTAATTGCCATTCTTTTAAACCAGGTAACACTTTTATAAC 7740
     *  T  S  M  E  L  F  *  L  P  F  F  *  T  R  *  H  F  Y  N
      K  H  Q  W  N  C  F  N  C  H  S  F  K  P  G  N  T  F  I  T
       N  I  N  G  I  V  L  I  A  I  L  L  N  Q  V  T  L  L  *  L

7741 TGTAGAAGCTGCTATAGAACTTTCTAAAGAGCTTAAACGACCTGTAAACCCAACTGATGC 7800
     C  R  S  C  Y  R  T  F  *  R  A  *  T  T  C  K  P  N  *  C
      V  E  A  A  I  E  L  S  K  E  L  K  R  P  V  N  P  T  D  A
       *  K  L  L  *  N  F  L  K  S  L  N  D  L  *  T  Q  L  M  L

7801 TTCACATTATGTAGTTACTGATATTAAGCAAGTTGGTTGTATGATGCGTTTGTTCTATGA 7860
     F  T  L  C  S  Y  *  Y  *  A  S  W  L  Y  D  A  F  V  L  *
      S  H  Y  V  V  T  D  I  K  Q  V  G  C  M  M  R  L  F  Y  D
       H  I  M  *  L  L  I  L  S  K  L  V  V  *  C  V  C  S  M  I

7861 TAGAGATGGACAGCGTGTTTACGATGATGTTGATGCTAGTTTATTTGTAGATATTAATAA 7920
     *  R  W  T  A  C  L  R  *  C  *  C  *  F  I  C  R  Y  *  *
      R  D  G  Q  R  V  Y  D  D  V  D  A  S  L  F  V  D  I  N  N
       E  M  D  S  V  F  T  M  M  L  M  L  V  Y  L  *  I  L  I  I

7921 TCTGTTACATTCTAAAGTCAAAGTTGTTCCTAATTTGTATGTAGTTGTAGTAGAGAGTGA 7980
     S  V  T  F  *  S  Q  S  C  S  *  F  V  C  S  C  S  R  E  *
      L  L  H  S  K  V  K  V  V  P  N  L  Y  V  V  V  V  E  S  D
       C  Y  I  L  K  S  K  L  F  L  I  C  M  *  L  *  *  R  V  M

7981 TGCTGATAGAGCTAATTTTCTGAATGCTGTTGTGTTTTATGCACAATCATTGTATAGGCC 8040
     C  *  *  S  *  F  S  E  C  C  C  V  L  C  T  I  I  V  *  A
      A  D  R  A  N  F  L  N  A  V  V  F  Y  A  Q  S  L  Y  R  P
       L  I  E  L  I  F  *  M  L  L  C  F  M  H  N  H  C  I  G  L

8041 TATATTACTTGTAGACAAAAAGTTAATTACTACAGCTTGTAATGGTATCTCTGTAACCCA 8100
     Y  I  T  C  R  Q  K  V  N  Y  Y  S  L  *  W  Y  L  C  N  P
      I  L  L  V  D  K  K  L  I  T  T  A  C  N  G  I  S  V  T  Q
       Y  Y  L  *  T  K  S  *  L  L  Q  L  V  M  V  S  L  *  P  R
```

FIG. 9 CONT.

```
8101 GACTATGTTTGATGTTTATGTTGATACTTTTATGTCTCATTTTGATGTTGATAGAAAGAG 8160
     D  Y  V  *  C  L  C  *  Y  F  Y  V  S  F  *  C  *  *  K  E
      T  M  F  D  V  Y  V  D  T  F  M  S  H  F  D  V  D  R  K  S
       L  C  L  M  F  M  L  I  L  L  C  L  I  L  M  L  I  E  R  V

8161 TTTTAATAATTTTGTTAACATTGCTCATGCTTCTCTTAGAGAGGGTGTGCAATTAGAAAA 8220
     F  *  *  F  C  *  H  C  S  C  F  S  *  R  G  C  A  I  R  K
      F  N  N  F  V  N  I  A  H  A  S  L  R  E  G  V  Q  L  E  K
       L  I  I  L  L  T  L  L  M  L  L  L  E  R  V  C  N  *  K  R

8221 GGTTTTAGATACTTTTGTGGGATGTGTACGTAAATGTTGTTCCATTGATTCAGATGTTGA 8280
     G  F  R  Y  F  C  G  M  C  T  *  M  L  F  H  *  F  R  C  *
      V  L  D  T  F  V  G  C  V  R  K  C  C  S  I  D  S  D  V  E
       F  *  I  L  L  W  D  V  Y  V  N  V  V  P  L  I  Q  M  L  K

8281 AACAAGATTTATTACTAAATCTATGATATCTGCAGTAGCTGCTGGTTTGGAATTTACTGA 8340
     N  K  I  Y  Y  *  I  Y  D  I  C  S  S  C  W  F  G  I  Y  *
      T  R  F  I  T  K  S  M  I  S  A  V  A  A  G  L  E  F  T  D
       Q  D  L  L  L  N  L  *  Y  L  Q  *  L  L  V  W  N  L  L  M

8341 TGAAAATTATAACAATTTGGTACCTACATATTTAAAGAGTGATAATATTGTAGCTGCAGA 8400
     *  K  L  *  Q  F  G  T  Y  I  F  K  E  *  *  Y  C  S  C  R
      E  N  Y  N  N  L  V  P  T  Y  L  K  S  D  N  I  V  A  A  D
       K  I  I  T  I  W  Y  L  H  I  *  R  V  I  I  L  *  L  Q  I

8401 TTTAGGTGTTCTTATACAGAATGGTGCTAAGCATGTACAGGGTAATGTTGCTAAGGCAGC 8460
     F  R  C  S  Y  T  E  W  C  *  A  C  T  G  *  C  C  *  G  S
      L  G  V  L  I  Q  N  G  A  K  H  V  Q  G  N  V  A  K  A  A
       *  V  F  L  Y  R  M  V  L  S  M  Y  R  V  M  L  L  R  Q  L

8461 TAATATTTCTTGTATATGGTTTATTGACACTTTTAATCAACTTACTGCTGATTTACAGCA 8520
     *  Y  F  L  Y  M  V  Y  *  H  F  *  S  T  Y  C  *  F  T  A
      N  I  S  C  I  W  F  I  D  T  F  N  Q  L  T  A  D  L  Q  H
       I  F  L  V  Y  G  L  L  T  L  L  I  N  L  L  L  I  Y  S  I

8521 TAAATTAAAAAAAGCATGTGTTAAAACTGGCTTGAAGTTAAAATTGACTTTTAATAAGCA 8580
     *  I  K  K  S  M  C  *  N  W  L  E  V  K  I  D  F  *  *  A
      K  L  K  K  A  C  V  K  T  G  L  K  L  K  L  T  F  N  K  Q
       N  *  K  K  H  V  L  K  L  A  *  S  *  N  *  L  L  I  S  K

8581 AGAGGCAAGTGTTCCTATTCTTACAACGCCCTTTTCACTTAAAGGAGGTGTTGTATTGAG 8640
     R  G  K  C  S  Y  S  Y  N  A  L  F  T  *  R  R  C  C  I  E
      E  A  S  V  P  I  L  T  T  P  F  S  L  K  G  G  V  V  L  S
       R  Q  V  F  L  F  L  Q  R  P  F  H  L  K  E  V  L  Y  *  V
```

FIG. 9 CONT.

```
8641 TAATTTGTTATATATATTATTTTTTATTAGTTTAATCTGTTTTATATTATTGTGGGCTTT 8700
      *  F  V  I  Y  I  I  F  Y  *  F  N  L  F  Y  I  I  V  G  F
       N  L  L  Y  I  L  F  F  I  S  L  I  C  F  I  L  L  W  A  L
        I  C  Y  I  Y  Y  F  L  L  V  *  S  V  L  Y  Y  C  G  L  Y

8701 ACTGCCTACATATAGTGTTTATAAGTCTGATATTCATTTGCCTGCTTATGCTAGTTTTAA 8760
      T  A  Y  I  *  C  L  *  V  *  Y  S  F  A  C  L  C  *  F  *
       L  P  T  Y  S  V  Y  K  S  D  I  H  L  P  A  Y  A  S  F  K
        C  L  H  I  V  F  I  S  L  I  F  I  C  L  L  M  L  V  L  K

8761 AGTTATTGATAATGGTGTTGTTAGAGATATTTCAGTTAATGATTTATGTTTTGCTAATAA 8820
      S  Y  *  *  W  C  C  *  R  Y  F  S  *  *  F  M  F  C  *  *
       V  I  D  N  G  V  V  R  D  I  S  V  N  D  L  C  F  A  N  K
        L  L  I  M  V  L  L  E  I  F  Q  L  M  I  Y  V  L  L  I  N

8821 ATTTTTCCAATTTGATCAATGGTATGAGTCCACTTTTGGGTCTTTTTACTATCATAATTC 8880
      I  F  P  I  *  S  M  V  *  V  H  F  W  V  F  L  L  S  *  F
       F  F  Q  F  D  Q  W  Y  E  S  T  F  G  S  F  Y  Y  H  N  S
        F  S  N  L  I  N  G  M  S  P  L  L  G  L  F  T  I  I  I  L

8881 TATGGATTGCCCTATTGTTGTGGCAGTTATGGATGAAGATATTGGTTCTACTATGTTTAA 8940
      Y  G  L  P  Y  C  C  G  S  Y  G  *  R  Y  W  F  Y  Y  V  *
       M  D  C  P  I  V  V  A  V  M  D  E  D  I  G  S  T  M  F  N
        W  I  A  L  L  L  W  Q  L  W  M  K  I  L  V  L  L  C  L  M

8941 TGTTCCTACTAAAGTTTTGAGACATGGCTTTCATGTTTTACATTTTCTAACTTATGCATT 9000
      C  S  Y  *  S  F  E  T  W  L  S  C  F  T  F  S  N  L  C  I
       V  P  T  K  V  L  R  H  G  F  H  V  L  H  F  L  T  Y  A  F
        F  L  L  K  F  *  D  M  A  F  M  F  Y  I  F  *  L  M  H  L

9001 TGCTAGTGATAGTGTTCAGTGCTATACACCACATATTCAGATTTCTTATAATGATTTTTA 9060
      C  *  *  *  C  S  V  L  Y  T  T  Y  S  D  F  L  *  *  F  L
       A  S  D  S  V  Q  C  Y  T  P  H  I  Q  I  S  Y  N  D  F  Y
        L  V  I  V  F  S  A  I  H  H  I  F  R  F  L  I  M  I  F  M

9061 TGCTAGTGGTTGTGTTTTATCATCTTTGTGTACTATGTTTAAAAGAGGTGATGGTACACC 9120
      C  *  W  L  C  F  I  I  F  V  Y  Y  V  *  K  R  *  W  Y  T
       A  S  G  C  V  L  S  S  L  C  T  M  F  K  R  G  D  G  T  P
        L  V  V  V  F  Y  H  L  C  V  L  C  L  K  E  V  M  V  H  H

9121 ACATCCTTATTGTTATTCAGATGGTGTTATGAAGAATGCTTCTTTGTATACATCTTTGGT 9180
      T  S  L  L  L  F  R  W  C  Y  E  E  C  F  F  V  Y  I  F  G
       H  P  Y  C  Y  S  D  G  V  M  K  N  A  S  L  Y  T  S  L  V
        I  L  I  V  I  Q  M  V  L  *  R  M  L  L  C  I  H  L  W  F
```

FIG. 9 CONT.

```
9181 TCCACATACACGTTATAGCCTTGCTAATTCTAATGGTTTTATAAGATTTCCTGATGTTAT 9240
     S  T  Y  T  L  *  P  C  *  F  *  W  F  Y  K  I  S  *  C  Y
      P  H  T  R  Y  S  L  A  N  S  N  G  F  I  R  F  P  D  V  I
       H  I  H  V  I  A  L  L  I  L  M  V  L  *  D  F  L  M  L  L

9241 TAGTGAAGGTATTGTACGTATTGTAAGAACGCGCTCTATGACTTATTGTAGAGTGGGTGC 9300
     *  *  R  Y  C  T  Y  C  K  N  A  L  Y  D  L  L  *  S  G  C
      S  E  G  I  V  R  I  V  R  T  R  S  M  T  Y  C  R  V  G  A
       V  K  V  L  Y  V  L  *  E  R  A  L  *  L  I  V  E  W  V  H

9301 ATGTGAATATGCCGAAGAGGGTATATGTTTTAATTTTAATAGTTCCTGGGTTTTGAATAA 9360
     M  *  I  C  R  R  G  Y  M  F  *  F  *  *  F  L  G  F  E  *
      C  E  Y  A  E  E  G  I  C  F  N  F  N  S  S  W  V  L  N  N
       V  N  M  P  K  R  V  Y  V  L  I  L  I  V  P  G  F  *  I  M

9361 TGATTATTATAGAAGTATGCCTGGAACTTTTTGTGGTAGAGATCTTTTTGATTTGTTTTA 9420
     *  L  L  *  K  Y  A  W  N  F  L  W  *  R  S  F  *  F  V  L
      D  Y  Y  R  S  M  P  G  T  F  C  G  R  D  L  F  D  L  F  Y
       I  I  I  E  V  C  L  E  L  F  V  V  E  I  F  L  I  C  F  I

9421 TCAATTTTTTAGTAGTTTAATTCGTCCTATAGATTTCTTTTCTCTTACTGCTAGTTCTAT 9480
     S  I  F  *  *  F  N  S  S  Y  R  F  L  F  S  Y  C  *  F  Y
      Q  F  F  S  S  L  I  R  P  I  D  F  F  S  L  T  A  S  S  I
       N  F  L  V  V  *  F  V  L  *  I  S  F  L  L  L  L  V  L  F

9481 TTTTGGAGCTATATTGGCTATAGTCGTTGTCTTGGTTTTTATTATTTAATAAAACTTAA 9540
     F  W  S  Y  I  G  Y  S  R  C  L  G  F  L  L  F  N  K  T  *
      F  G  A  I  L  A  I  V  V  V  L  V  F  Y  Y  L  I  K  L  K
       L  E  L  Y  W  L  *  S  L  S  W  F  F  I  I  *  *  N  L  S

9541 GCGTGCTTTTGGAGATTATACTAGTGTTGTAGTTATAAATGTTATTGTTTGGTGTATTAA 9600
     A  C  F  W  R  L  Y  *  C  C  S  Y  K  C  Y  C  L  V  Y  *
      R  A  F  G  D  Y  T  S  V  V  V  I  N  V  I  V  W  C  I  N
       V  L  L  E  I  I  L  V  L  *  L  *  M  L  L  F  G  V  L  I

9601 TTTTCTTATGCTTTTTGTTTTTCAAGTTTATCCTATTTGTGCATGTGTCTATGCTTGTTT 9660
     F  S  Y  A  F  C  F  S  S  L  S  Y  L  C  M  C  L  C  L  F
      F  L  M  L  F  V  F  Q  V  Y  P  I  C  A  C  V  Y  A  C  F
       F  L  C  F  L  F  F  K  F  I  L  F  V  H  V  S  M  L  V  F

9661 TTATTTTTATGTAACATTGTATTTTCCTTCTGAAATTAGTGTAATTATGCATTTGCAATG 9720
     L  F  L  C  N  I  V  F  S  F  *  N  *  C  N  Y  A  F  A  M
      Y  F  Y  V  T  L  Y  F  P  S  E  I  S  V  I  M  H  L  Q  W
       I  F  M  *  H  C  I  F  L  L  K  L  V  *  L  C  I  C  N  G
```

FIG. 9 CONT.

```
9781 TATTGCAAACCATGTTTTATGGTTATTTTCATATTGTAGGAAAATTGGTGTTAATGTATG 9840
     Y  C  K  P  C  F  M  V  I  F  I  L  *  E  N  W  C  *  C  M
      I  A  N  H  V  L  W  L  F  S  Y  C  R  K  I  G  V  N  V  C
       L  Q  T  M  F  Y  G  Y  F  H  I  V  G  K  L  V  L  M  Y  V

9841 TAATGATAGTACATTTGAAGAAACATCTCTTACTACTTTTATGATTACTAAAGATTCTTA 9900
     *  *  *  Y  I  *  R  N  I  S  Y  Y  F  Y  D  Y  *  R  F  L
      N  D  S  T  F  E  E  T  S  L  T  T  F  M  I  T  K  D  S  Y
       M  I  V  H  L  K  K  H  L  L  L  L  L  *  L  L  K  I  L  I

9901 TTGTAGATTAAAGAATTCTGTTTCTGATGTTGCTTACAATAGATATTTGAGTTTGTATAA 9960
     L  *  I  K  E  F  C  F  *  C  C  L  Q  *  I  F  E  F  V  *
      C  R  L  K  N  S  V  S  D  V  A  Y  N  R  Y  L  S  L  Y  N
       V  D  *  R  I  L  F  L  M  L  L  T  I  D  I  *  V  C  I  I

9961 TAAGTATCGTTACTATAGTGGTAAAATGGATACTGCTGCCTATAGAGAAGCGGCGTGTTC 10020
     *  V  S  L  L  *  W  *  N  G  Y  C  C  L  *  R  S  G  V  F
      K  Y  R  Y  Y  S  G  K  M  D  T  A  A  Y  R  E  A  A  C  S
       S  I  V  T  I  V  V  K  W  I  L  L  P  I  E  K  R  R  V  L

10021 TCAGTTAGCTAAAGCTATGGAAACATTTAATCACAATAATGGTAATGATGTCTTATACCA 10080
      S  V  S  *  S  Y  G  N  I  *  S  Q  *  W  *  *  C  L  I  P
       Q  L  A  K  A  M  E  T  F  N  H  N  N  G  N  D  V  L  Y  Q
        S  *  L  K  L  W  K  H  L  I  T  I  M  V  M  M  S  Y  T  N

10081 ACCTCCTACAGCATCTGTTTCTACATCTTTTTTGCAATCAGGTATTGTAAAGATGGTATC 10140
      T  S  Y  S  I  C  F  Y  I  F  F  A  I  R  Y  C  K  D  G  I
       P  P  T  A  S  V  S  T  S  F  L  Q  S  G  I  V  K  M  V  S
        L  L  Q  H  L  F  L  H  L  F  C  N  Q  V  L  *  R  W  Y  L

10141 TCCTACGTCAAAAATTGAACCTTGTATTGTTAGTGTTACTTATGGTAGTATGACTTTGAA 10200
      S  Y  V  K  N  *  T  L  Y  C  *  C  Y  L  W  *  Y  D  F  E
       P  T  S  K  I  E  P  C  I  V  S  V  T  Y  G  S  M  T  L  N
        L  R  Q  K  L  N  L  V  L  L  V  L  L  M  V  V  *  L  *  M

10201 TGGTTTATGGTTAGATGACAAAGTTTATTGTCCTCGTCATGTTATATGTTTATCCTCTAA 10260
      W  F  M  V  R  *  Q  S  L  L  S  S  S  C  Y  M  F  I  L  *
       G  L  W  L  D  D  K  V  Y  C  P  R  H  V  I  C  L  S  S  N
        V  Y  G  *  M  T  K  F  I  V  L  V  M  L  Y  V  Y  P  L  I

10261 TATGAATGAACCTGATTATTCTGCCTTATTATGTAGAGTTACTCTAGGTGATTTTACTAT 10320
      Y  E  *  T  *  L  F  C  L  I  M  *  S  Y  S  R  *  F  Y  Y
       M  N  E  P  D  Y  S  A  L  L  C  R  V  T  L  G  D  F  T  I
        *  M  N  L  I  I  L  P  Y  Y  V  E  L  L  *  V  I  L  L  *
```

FIG. 9 CONT.

```
 9721 GATTGTTATGTATGGTGCTATAATGCCTTTTTGGTTTTGTGTCACATATGTAGCTATGGT 9780
      D  C  Y  V  W  C  Y  N  A  F  L  V  L  C  H  I  C  S  Y  G
       I  V  M  Y  G  A  I  M  P  F  W  F  C  V  T  Y  V  A  M  V
        L  L  C  M  V  L  *  C  L  F  G  F  V  S  H  M  *  L  W  L

10321 AATGTCTGGGCGGATGAGTTTAACAGTTGTGTCTTACCAGATGCAGGGCTGTCAACTTGT 10380
      N  V  W  A  D  E  F  N  S  C  V  L  P  D  A  G  L  S  T  C
       M  S  G  R  M  S  L  T  V  V  S  Y  Q  M  Q  G  C  Q  L  V
        C  L  G  G  *  V  *  Q  L  C  L  T  R  C  R  A  V  N  L  F

10381 TTTGACAGTCTCTTTACAAAATCCTTACACTCCAAAATATACTTTTGGTGTTGTTAAACC 10440
      F  D  S  L  F  T  K  S  L  H  S  K  I  Y  F  W  C  C  *  T
       L  T  V  S  L  Q  N  P  Y  T  P  K  Y  T  F  G  V  V  K  P
        *  Q  S  L  Y  K  I  L  T  L  Q  N  I  L  L  V  L  L  N  L

10441 TGGTGAAACTTTTACTGTTTTAGCTGCGTATAATGGCCGACCACAAGGGGCATTTCATGT 10500
      W  *  N  F  Y  C  F  S  C  V  *  W  P  T  T  R  G  I  S  C
       G  E  T  F  T  V  L  A  A  Y  N  G  R  P  Q  G  A  F  H  V
        V  K  L  L  L  F  *  L  R  I  M  A  D  H  K  G  H  F  M  L

10501 TACTATGCGTAGTAGTTATACTATTAAAGGTTCTTTTTTGTGTGGGTCATGTGGATCTGT 10560
      Y  Y  A  *  *  L  Y  Y  *  R  F  F  F  V  W  V  M  W  I  C
       T  M  R  S  S  Y  T  I  K  G  S  F  L  C  G  S  C  G  S  V
        L  C  V  V  V  I  L  L  K  V  L  F  C  V  G  H  V  D  L  L

10561 TGGTTATGTATTAACAGGTGATAGTGTTAAGTTTGTATATATGCATCAATTAGAGCTCAG 10620
      W  L  C  I  N  R  *  *  C  *  V  C  I  Y  A  S  I  R  A  Q
       G  Y  V  L  T  G  D  S  V  K  F  V  Y  M  H  Q  L  E  L  S
        V  M  Y  *  Q  V  I  V  L  S  L  Y  I  C  I  N  *  S  S  V

10621 TACTGGTTGTCACACTGGCACTGATTTTACTGGTAATTTTTATGGTCCATATAGAGATGC 10680
      Y  W  L  S  H  W  H  *  F  Y  W  *  F  L  W  S  I  *  R  C
       T  G  C  H  T  G  T  D  F  T  G  N  F  Y  G  P  Y  R  D  A
        L  V  V  T  L  A  L  I  L  L  V  I  F  M  V  H  I  E  M  L

10681 TCAAGTTGTACAGTTGCCAGTTAAGGACTACGTCCAAACTGTTAATGTTATTGCTTGGCT 10740
      S  S  C  T  V  A  S  *  G  L  R  P  N  C  *  C  Y  C  L  A
       Q  V  V  Q  L  P  V  K  D  Y  V  Q  T  V  N  V  I  A  W  L
        K  L  Y  S  C  Q  L  R  T  T  S  K  L  L  M  L  L  L  G  S

10741 CTATGCAGCTATACTTAATAATTGTGCTTGGTTTGTACAAAATGATGTTTGTTCTATTGA 10800
      L  C  S  Y  T  *  *  L  C  L  V  C  T  K  *  C  L  F  Y  *
       Y  A  A  I  L  N  N  C  A  W  F  V  Q  N  D  V  C  S  I  E
        M  Q  L  Y  L  I  I  V  L  G  L  Y  K  M  M  F  V  L  L  K
```

FIG. 9 CONT.

```
10801 AGATTTTAATGTTTGGGCTATGACAAATGGTTTTAGCCAAGTAAAAGCAGATCTTGTTTT 10860
      R  F  *  C  L  G  Y  D  K  W  F  *  P  S  K  S  R  S  C  F
       D  F  N  V  W  A  M  T  N  G  F  S  Q  V  K  A  D  L  V  L
        I  L  M  F  G  L  *  Q  M  V  L  A  K  *  K  Q  I  L  F  *

10861 AGATGCTTTGGCTTCAATGACAGGTGTTTCTATTGAAACTTTATTGGCTGCTATTAAGCG 10920
      R  C  F  G  F  N  D  R  C  F  Y  *  N  F  I  G  C  Y  *  A
       D  A  L  A  S  M  T  G  V  S  I  E  T  L  L  A  A  I  K  R
        M  L  W  L  Q  *  Q  V  F  L  L  K  L  Y  W  L  L  L  S  V

10921 TCTATATATGGGATTTCAAGGTCGTCAAATACTAGGAAGTTGTACTTTTGAAGATGAATT 10980
      S  I  Y  G  I  S  R  S  S  N  T  R  K  L  Y  F  *  R  *  I
       L  Y  M  G  F  Q  G  R  Q  I  L  G  S  C  T  F  E  D  E  L
        Y  I  W  D  F  K  V  V  K  Y  *  E  V  V  L  L  K  M  N  W

10981 GGCACCTTCTGACGTTTATCAACAATTGGCTGGTGTTAAATTGCAATCTAAAACAAAAAG 11040
      G  T  F  *  R  L  S  T  I  G  W  C  *  I  A  I  *  N  K  K
       A  P  S  D  V  Y  Q  Q  L  A  G  V  K  L  Q  S  K  T  K  R
        H  L  L  T  F  I  N  N  W  L  V  L  N  C  N  L  K  Q  K  D

11041 ATTTATTAAAGAAACAATTTATTGGATTTTGATATCTACATTTTTGTTTAGTTGTATAAT 11100
      I  Y  *  R  N  N  L  L  D  F  D  I  Y  I  F  V  *  L  Y  N
       F  I  K  E  T  I  Y  W  I  L  I  S  T  F  L  F  S  C  I  I
        L  L  K  K  Q  F  I  G  F  *  Y  L  H  F  C  L  V  V  *  F

11101 TTCTGCATTTGTTAAATGGACTATATTTATGTATATTAATACACATATGATTGGTGTTAC 11160
      F  C  I  C  *  M  D  Y  I  Y  V  Y  *  Y  T  Y  D  W  C  Y
       S  A  F  V  K  W  T  I  F  M  Y  I  N  T  H  M  I  G  V  T
        L  H  L  L  N  G  L  Y  L  C  I  L  I  H  I  *  L  V  L  H

11161 ATTATGTGTACTTTGTTTTGTTAGTTTTATGATGTTACTAGTTAAACATAAGCATTTTTA 11220
      I  M  C  T  L  F  C  *  F  Y  D  V  T  S  *  T  *  A  F  L
       L  C  V  L  C  F  V  S  F  M  M  L  L  V  K  H  K  H  F  Y
        Y  V  Y  F  V  L  L  V  L  *  C  Y  *  L  N  I  S  I  F  I

11221 TTTGACTATGTATATAATTCCTGTACTCTGTACCTTGTTTTATGTAAATTATTTAGTTGT 11280
      F  D  Y  V  Y  N  S  C  T  L  Y  L  V  L  C  K  L  F  S  C
       L  T  M  Y  I  I  P  V  L  C  T  L  F  Y  V  N  Y  L  V  V
        *  L  C  I  *  F  L  Y  S  V  P  C  F  M  *  I  I  *  L  S

11281 CTATAAGGAAGGTTTTAGAGGTCTTACTTATGTCTGGCTCTCATATTTTGTTCCTGCTGT 11340
      L  *  G  R  F  *  R  S  Y  L  C  L  A  L  I  F  C  S  C  C
       Y  K  E  G  F  R  G  L  T  Y  V  W  L  S  Y  F  V  P  A  V
        I  R  K  V  L  E  V  L  L  M  S  G  S  H  I  L  F  L  L  *
```

FIG. 9 CONT.

```
11341 GAATTTTACTTATGTTTATGAAGTATTTTATGGTTGTATTTTATGTGTTTTTGCTATTTT 11400
      E  F  Y  L  C  L  *  S  I  L  W  L  Y  F  M  C  F  C  Y  F
       N  F  T  Y  V  Y  E  V  F  Y  G  C  I  L  C  V  F  A  I  F
        I  L  L  M  F  M  K  Y  F  M  V  V  F  Y  V  F  L  L  F  L

11401 TATAACTATGCATAGTATTAATCATGACATTTTTTCTTTGATGTTTTTGGTTGGTAGAAT 11460
      Y  N  Y  A  *  Y  *  S  *  H  F  F  F  D  V  F  G  W  *  N
       I  T  M  H  S  I  N  H  D  I  F  S  L  M  F  L  V  G  R  I
        *  L  C  I  V  L  I  M  T  F  F  L  *  C  F  W  L  V  E  *

11461 AGTTACTTTAATTTCTATGTGGTATTTTGGGTCGAATTTAGAAGAGGATGTTTTGTTATT 11520
      S  Y  F  N  F  Y  V  V  F  W  V  E  F  R  R  G  C  F  V  I
       V  T  L  I  S  M  W  Y  F  G  S  N  L  E  E  D  V  L  L  F
        L  L  *  F  L  C  G  I  L  G  R  I  *  K  R  M  F  C  Y  L

11521 TATTACAGCCTTTTTAGGTACTTATACATGGACCACTATTTTGTCATTAGCTATAGCAAA 11580
      Y  Y  S  L  F  R  Y  L  Y  M  D  H  Y  F  V  I  S  Y  S  K
       I  T  A  F  L  G  T  Y  T  W  T  T  I  L  S  L  A  I  A  K
        L  Q  P  F  *  V  L  I  H  G  P  L  F  C  H  *  L  *  Q  K

11581 AATTGTTGCTAATTGGTTGTCTGTTAATATATTTTATTTTACAGATGTACCTTATATTAA 11640
      N  C  C  *  L  V  V  C  *  Y  I  L  F  Y  R  C  T  L  Y  *
       I  V  A  N  W  L  S  V  N  I  F  Y  F  T  D  V  P  Y  I  K
        L  L  L  I  G  C  L  L  I  Y  F  I  L  Q  M  Y  L  I  L  N

11641 ATTGATTCTTTTGAGTTACTTATTTATAGGGTATATTTTATCTTGTTATTGGGGATTTTT 11700
      I  D  S  F  E  L  L  I  Y  R  V  Y  F  I  L  L  L  G  I  F
       L  I  L  L  S  Y  L  F  I  G  Y  I  L  S  C  Y  W  G  F  F
        *  F  F  *  V  T  Y  L  *  G  I  F  Y  L  V  I  G  D  F  S

11701 CTCTCTTTTAAACAGTGTTTTTAGAATGCCTATGGGTGTTTATAATTATAAAATTTCTGT 11760
      L  S  F  K  Q  C  F  *  N  A  Y  G  C  L  *  L  *  N  F  C
       S  L  L  N  S  V  F  R  M  P  M  G  V  Y  N  Y  K  I  S  V
        L  F  *  T  V  F  L  E  C  L  W  V  F  I  I  I  K  F  L  F

11761 TCAAGAATTGCGTTATATGAATGCTAATGGCTTACGTCCACCCCGTAATAGTTTTGAGGC 11820
      S  R  I  A  L  Y  E  C  *  W  L  T  S  T  P  *  *  F  *  G
       Q  E  L  R  Y  M  N  A  N  G  L  R  P  P  R  N  S  F  E  A
        K  N  C  V  I  *  M  L  M  A  Y  V  H  P  V  I  V  L  R  L

11821 TATTTTGTTAAATTTAAAACTGCTTGGAATAGGTGGCGTGCCAGTTATTGAAGTTTCTCA 11880
      Y  F  V  K  F  K  T  A  W  N  R  W  R  A  S  Y  *  S  F  S
       I  L  L  N  L  K  L  L  G  I  G  G  V  P  V  I  E  V  S  Q
        F  C  *  I  *  N  C  L  E  *  V  A  C  Q  L  L  K  F  L  K
```

FIG. 9 CONT.

```
11881 AATTCAATCAAAATTGACTGATGTGAAATGTGCTAATGTTGTTTTGTTAAATTGTTTACA 11940
      N  S  I  K  I  D  *  C  E  M  C  *  C  C  F  V  K  L  F  T
       I  Q  S  K  L  T  D  V  K  C  A  N  V  V  L  L  N  C  L  Q
        F  N  Q  N  *  L  M  *  N  V  L  M  L  F  C  *  I  V  Y  S

11941 GCATTTGCATGTTGCTTCTAATTCTAGGTTGTGGCAGTATTGTAGTATTTTACATAATGA 12000
      A  F  A  C  C  F  *  F  *  V  V  A  V  L  *  Y  F  T  *  *
       H  L  H  V  A  S  N  S  R  L  W  Q  Y  C  S  I  L  H  N  E
        I  C  M  L  L  L  I  L  G  C  G  S  I  V  V  F  Y  I  M  K

12001 AATACTATCTACTTCAGATTTAAGTGTAGCTTTTGATAAGCTTGCTCAATTATTGATTGT 12060
      N  T  I  Y  F  R  F  K  C  S  F  *  *  A  C  S  I  I  D  C
       I  L  S  T  S  D  L  S  V  A  F  D  K  L  A  Q  L  L  I  V
        Y  Y  L  L  Q  I  *  V  *  L  L  I  S  L  L  N  Y  *  L  F

12061 TTTATTCGCCAATCCTGCTGCAGTTGATACTAAGTGTCTTGCAAGTATAGATGAAGTTAG 12120
      F  I  R  Q  S  C  C  S  *  Y  *  V  S  C  K  Y  R  *  S  *
       L  F  A  N  P  A  A  V  D  T  K  C  L  A  S  I  D  E  V  S
        Y  S  P  I  L  L  Q  L  I  L  S  V  L  Q  V  *  M  K  L  A

12121 CGATGATTATGTTCAAGATAGTACTGTTTTGCAGGCTTTGCAAAGTGAGTTTGTAAATAT 12180
      R  *  L  C  S  R  *  Y  C  F  A  G  F  A  K  *  V  C  K  Y
       D  D  Y  V  Q  D  S  T  V  L  Q  A  L  Q  S  E  F  V  N  M
        M  I  M  F  K  I  V  L  F  C  R  L  C  K  V  S  L  *  I  W

12181 GGCTAGTTTTGTTGAATATGAAGTCGCAAAGAAAAATTTGGCTGATGCTAAAAATAGTGG 12240
      G  *  F  C  *  I  *  S  R  K  E  K  F  G  *  C  *  K  *  W
       A  S  F  V  E  Y  E  V  A  K  K  N  L  A  D  A  K  N  S  G
        L  V  L  L  N  M  K  S  Q  R  K  I  W  L  M  L  K  I  V  V

12241 TTCTGTTAATCAACAACAGATAAAACAGTTAGAAAAGGCATGTAATATAGCTAAGTCTGT 12300
      F  C  *  S  T  T  D  K  T  V  R  K  G  M  *  Y  S  *  V  C
       S  V  N  Q  Q  Q  I  K  Q  L  E  K  A  C  N  I  A  K  S  V
        L  L  I  N  N  R  *  N  S  *  K  R  H  V  I  *  L  S  L  C

12301 GTATGAACGCGATAAAGCTGTAGCTCGCAAACTGGAACGTATGGCAGACCTAGCACTTAC 12360
      V  *  T  R  *  S  C  S  S  Q  T  G  T  Y  G  R  P  S  T  Y
       Y  E  R  D  K  A  V  A  R  K  L  E  R  M  A  D  L  A  L  T
        M  N  A  I  K  L  *  L  A  N  W  N  V  W  Q  T  *  H  L  L

12361 TAACATGTATAAAGAGGCTCGGATTAATGATAAGAAGAGTAAAGTTGTTTCCGCTTTGCA 12420
      *  H  V  *  R  G  S  D  *  *  *  E  E  *  S  C  F  R  F  A
       N  M  Y  K  E  A  R  I  N  D  K  K  S  K  V  V  S  A  L  Q
        T  C  I  K  R  L  G  L  M  I  R  R  V  K  L  F  P  L  C  R
```

FIG. 9 CONT.

```
12421 GACAATGCTTTTTAGCATGGTTCGTAAATTGGATAATCAGGCTTTAAATTCTATTCTGGA 12480
      D  N  A  F  *  H  G  S  *  I  G  *  S  G  F  K  F  Y  S  G
       T  M  L  F  S  M  V  R  K  L  D  N  Q  A  L  N  S  I  L  D
        Q  C  F  L  A  W  F  V  N  W  I  I  R  L  *  I  L  F  W  I

12481 TAATGCTGTTAAAGGTTGTGTACCTTTGAATGCTATTCCAGCGCTGGCTGCTAATACTTT 12540
      *  C  C  *  R  L  C  T  F  E  C  Y  S  S  A  G  C  *  Y  F
       N  A  V  K  G  C  V  P  L  N  A  I  P  A  L  A  A  N  T  L
        M  L  L  K  V  V  Y  L  *  M  L  F  Q  R  W  L  L  I  L  *

12541 AACTATAATAATACCAGATAAACAAGTTTTTGATAAAGTTGTTGATAATGTTTATGTTGC 12600
      N  Y  N  N  T  R  *  T  S  F  *  *  S  C  *  *  C  L  C  C
       T  I  I  I  P  D  K  Q  V  F  D  K  V  V  D  N  V  Y  V  A
        L  *  *  Y  Q  I  N  K  F  L  I  K  L  L  I  M  F  M  L  H

12601 ATATGCTGGTAGTGTATGGCATATACAGACTGTTCAAGATGCTGATGGTATTAATAAACA 12660
      I  C  W  *  C  M  A  Y  T  D  C  S  R  C  *  W  Y  *  *  T
       Y  A  G  S  V  W  H  I  Q  T  V  Q  D  A  D  G  I  N  K  Q
        M  L  V  V  Y  G  I  Y  R  L  F  K  M  L  M  V  L  I  N  S

12661 GTTAACTGATATTAGTGTTGATTCTAATTGGCCTCTTGTTATTATTGCTAACAGGTATAA 12720
      V  N  *  Y  *  C  *  F  *  L  A  S  C  Y  Y  C  *  Q  V  *
       L  T  D  I  S  V  D  S  N  W  P  L  V  I  I  A  N  R  Y  N
        *  L  I  L  V  L  I  L  I  G  L  L  L  L  L  L  T  G  I  M

12721 TGAAGTTGCTAATGCTGTTATGCAGAATAATGAGTTGATGCCTCATAAATTAAAAATACA 12780
      *  S  C  *  C  C  Y  A  E  *  *  V  D  A  S  *  I  K  N  T
       E  V  A  N  A  V  M  Q  N  N  E  L  M  P  H  K  L  K  I  Q
        K  L  L  M  L  L  C  R  I  M  S  *  C  L  I  N  *  K  Y  K

12781 AGTTGTTAATAGTGGTTCTGATATGAATTGTAACATTCCTACTCAATGTTATTATAATAA 12840
      S  C  *  *  W  F  *  Y  E  L  *  H  S  Y  S  M  L  L  *  *
       V  V  N  S  G  S  D  M  N  C  N  I  P  T  Q  C  Y  Y  N  N
        L  L  I  V  V  L  I  *  I  V  T  F  L  L  N  V  I  I  I  M

12841 TGGTAGTAGTGGTAGAATAGTTTATGCTGTTCTTAGTGATGTTGATGGTCTTAAGTATAC 12900
      W  *  *  W  *  N  S  L  C  C  S  *  *  C  *  W  S  *  V  Y
       G  S  S  G  R  I  V  Y  A  V  L  S  D  V  D  G  L  K  Y  T
        V  V  V  V  E  *  F  M  L  F  L  V  M  L  M  V  L  S  I  L

12901 TAAGATAATAAAAGATGATGGAAATTGTGTTGTTTTAGAGCTTGATCCTCCTTGTAAATT 12960
      *  D  N  K  R  *  W  K  L  C  C  F  R  A  *  S  S  L  *  I
       K  I  I  K  D  D  G  N  C  V  V  L  E  L  D  P  P  C  K  F
        R  *  *  K  M  M  E  I  V  L  F  *  S  L  I  L  L  V  N  F
```

FIG. 9 CONT.

```
12961 TTCTATACAAGATGTTAAGGGACTTAAAATTAAGTATCTTTATTTTATTAAAGGATGTAA 13020
      F  Y  T  R  C  *  G  T  *  N  *  V  S  L  F  Y  *  R  M  *
       S  I  Q  D  V  K  G  L  K  I  K  Y  L  Y  F  I  K  G  C  N
        L  Y  K  M  L  R  D  L  K  L  S  I  F  I  L  L  K  D  V  T

13021 CACTTTAGCTAGAGGGTGGGTTGTTGGTACTTTATCTTCAACAATTAGATTGCAGGCTGG 13080
      H  F  S  *  R  V  G  C  W  Y  F  I  F  N  N  *  I  A  G  W
       T  L  A  R  G  W  V  V  G  T  L  S  S  T  I  R  L  Q  A  G
        L  *  L  E  G  G  L  L  V  L  Y  L  Q  Q  L  D  C  R  L  V

13081 TGTTGCTACTGAGTATGCAGCTAATTCTTCTATACTTTCATTATGTGCATTTTCTGTAGA 13140
      C  C  Y  *  V  C  S  *  F  F  Y  T  F  I  M  C  I  F  C  R
       V  A  T  E  Y  A  A  N  S  S  I  L  S  L  C  A  F  S  V  D
        L  L  L  S  M  Q  L  I  L  L  Y  F  H  Y  V  H  F  L  *  I

13141 TCCTAAGAAAACTTATTTAGATTATATACAACAAGGTGGTGTACCTATAATTAATTGTGT 13200
      S  *  E  N  L  F  R  L  Y  T  T  R  W  C  T  Y  N  *  L  C
       P  K  K  T  Y  L  D  Y  I  Q  Q  G  G  V  P  I  I  N  C  V
        L  R  K  L  I  *  I  I  Y  N  K  V  V  Y  L  *  L  I  V  L

13201 TAAAATGCTCTGTGATCATGCTGGTACTGGTATGGCTATTACTATTAAACCTGAGGCTAC 13260
      *  N  A  L  *  S  C  W  Y  W  Y  G  Y  Y  Y  *  T  *  G  Y
       K  M  L  C  D  H  A  G  T  G  M  A  I  T  I  K  P  E  A  T
        K  C  S  V  I  M  L  V  L  V  W  L  L  L  L  N  L  R  L  L

13261 TATTAATCAAGATTCTTATGGTGGTGCCTCAGTTTGTATTTACTGCCGTGCACGTGTAGA 13320
      Y  *  S  R  F  L  W  W  C  L  S  L  Y  L  L  P  C  T  C  R
       I  N  Q  D  S  Y  G  G  A  S  V  C  I  Y  C  R  A  R  V  E
        L  I  K  I  L  M  V  V  P  Q  F  V  F  T  A  V  H  V  *  S

13321 GCATCCAGATGTAGATGGTTTGTGTAAATTACGTGGTAAATTTGTACAAGTCCCTTTGGG 13380
      A  S  R  C  R  W  F  V  *  I  T  W  *  I  C  T  S  P  F  G
       H  P  D  V  D  G  L  C  K  L  R  G  K  F  V  Q  V  P  L  G
        I  Q  M  *  M  V  C  V  N  Y  V  V  N  L  Y  K  S  L  W  V

13381 TATAAAAGATCCTATTCTCTATGTGTTAACACATGATGTTTGTCAAGTTTGTGGATTTTG 13440
      Y  K  R  S  Y  S  L  C  V  N  T  *  C  L  S  S  L  W  I  L
       I  K  D  P  I  L  Y  V  L  T  H  D  V  C  Q  V  C  G  F  W
        *  K  I  L  F  S  M  C  *  H  M  M  F  V  K  F  V  D  F  G

13441 GAGAGATGGCAGTTGTTCCTGTGTAGGTTCAGGTGTCGCTGTTCAATCTAAAGATTTAAA 13500
      E  R  W  Q  L  F  L  C  R  F  R  C  R  C  S  I  *  R  F  K
       R  D  G  S  C  S  C  V  G  S  G  V  A  V  Q  S  K  D  L  N
        E  M  A  V  V  P  V  *  V  Q  V  S  L  F  N  L  K  I  *  I
```

FIG. 9 CONT.

```
13501 TTTTTTAAACGGGTTCGGGGTACTAGTGTGAATGCCCGTCTAGTACCCTGTGCTAGTGGT 13560
      F  F  K  R  V  R  G  T  S  V  N  A  R  L  V  P  C  A  S  G
       F  L  N  G  F  G  V  L  V  *  M  P  V  *  Y  P  V  L  V  V
        F  *  T  G  S  G  Y  *  C  E  C  P  S  S  T  L  C  *  W  F

13561 TTATCTACTGATGTTCAATTAAGGGCATTTGATATTTGTAATACTAATAGAGCTGGTATA 13620
      L  S  T  D  V  Q  L  R  A  F  D  I  C  N  T  N  R  A  G  I
       Y  L  L  M  F  N  *  G  H  L  I  F  V  I  L  I  E  L  V  *
        I  Y  *  C  S  I  K  G  I  *  Y  L  *  Y  *  *  S  W  Y  R

13621 GGTTTATATTATAAAGTGAATTGTTGCCGTTTTCAGCGTATAGATGACGACGGTAATAAA 13680
      G  L  Y  Y  K  V  N  C  C  R  F  Q  R  I  D  D  D  G  N  K
       V  Y  I  I  K  *  I  V  A  V  F  S  V  *  M  T  T  V  I  N
        F  I  L  *  S  E  L  L  P  F  S  A  Y  R  *  R  R  *  *  I

13681 TTGGATAAGTTCTTTGTTGTTAAAAGAACTAATCTAGAAGTTTATAATAAAGAGAAAACT 13740
      L  D  K  F  F  V  V  K  R  T  N  L  E  V  Y  N  K  E  K  T
       W  I  S  S  L  L  L  K  E  L  I  *  K  F  I  I  K  R  K  L
        G  *  V  L  C  C  *  K  N  *  S  R  S  L  *  *  R  E  N  L

13741 TATTATGAGTTGACTAAAAGTTGTGGTGTTGTGGCTGAACATGATTTCTTTACATTTGAT 13800
      Y  Y  E  L  T  K  S  C  G  V  V  A  E  H  D  F  F  T  F  D
       I  M  S  *  L  K  V  V  V  L  W  L  N  M  I  S  L  H  L  I
        L  *  V  D  *  K  L  W  C  C  G  *  T  *  F  L  Y  I  *  Y

13801 ATTGATGGTAGTCGTGTGCCACATATAGTTCGTAAGAACCTCTCAAAGTATACTATGTTA 13860
      I  D  G  S  R  V  P  H  I  V  R  K  N  L  S  K  Y  T  M  L
       L  M  V  V  V  C  H  I  *  F  V  R  T  S  Q  S  I  L  C  *
        *  W  *  S  C  A  T  Y  S  S  *  E  P  L  K  V  Y  Y  V  R

13861 GATCTTTGCTATGCATTGCGCCATTTTGATTGTAATGATTGTTCAGTATTGTGTGAAATT 13920
      D  L  C  Y  A  L  R  H  F  D  C  N  D  C  S  V  L  C  E  I
       I  F  A  M  H  C  A  I  L  I  V  M  I  V  Q  Y  C  V  K  F
        S  L  L  C  I  A  P  F  *  L  *  *  L  F  S  I  V  *  N  S

13921 CTTTGTGAGTATGCTGATTGTAAAGAATCCTACTTTTCTAAGAAAGATTGGTATGATTTT 13980
      L  C  E  Y  A  D  C  K  E  S  Y  F  S  K  K  D  W  Y  D  F
       F  V  S  M  L  I  V  K  N  P  T  F  L  R  K  I  G  M  I  L
        L  *  V  C  *  L  *  R  I  L  L  F  *  E  R  L  V  *  F  C

13981 GTTGAAAATCCTGATATTATTAATATTTATAAAAAATTAGGCCCTATTTTTAATAGAGCT 14040
      V  E  N  P  D  I  I  N  I  Y  K  K  L  G  P  I  F  N  R  A
       L  K  I  L  I  L  L  I  F  I  K  N  *  A  L  F  L  I  E  L
        *  K  S  *  Y  Y  *  Y  L  *  K  I  R  P  Y  F  *  *  S  F
```

FIG. 9 CONT.

```
14041 TTACTTAATACTGTCAGTTTTGCAGATACTTTAGTAAAAGTAGGTTTAGTTGGTGTTTTA 14100
      L  L  N  T  V  S  F  A  D  T  L  V  K  V  G  L  V  G  V  L
       Y  L  I  L  S  V  L  Q  I  L  *  *  K  *  V  *  L  V  F  *
        T  *  Y  C  Q  F  C  R  Y  F  S  K  S  R  F  S  W  C  F  N

14101 ACTTTAGATAATCAAGACTTGTATGGTCAATGGTATGATTTTGGTGATTTTATACAAACA 14160
      T  L  D  N  Q  D  L  Y  G  Q  W  Y  D  F  G  D  F  I  Q  T
       L  *  I  I  K  T  C  M  V  N  G  M  I  L  V  I  L  Y  K  Q
        F  R  *  S  R  L  V  W  S  M  V  *  F  W  *  F  Y  T  N  S

14161 GCTCCAGGTTTTGGTGTGGCAGTTGCAGATTCTTACTATTCTTATATGATGCCTATGTTG 14220
      A  P  G  F  G  V  A  V  A  D  S  Y  Y  S  Y  M  M  P  M  L
       L  Q  V  L  V  W  Q  L  Q  I  L  T  I  L  I  *  C  L  C  *
        S  R  F  W  C  G  S  C  R  F  L  L  F  L  Y  D  A  Y  V  D

14221 ACTATGTGTCATGTATTAGATTGTGAATTATTTGTTAATGATAGTTATAGACAATTCGAT 14280
      T  M  C  H  V  L  D  C  E  L  F  V  N  D  S  Y  R  Q  F  D
       L  C  V  M  Y  *  I  V  N  Y  L  L  M  I  V  I  D  N  S  I
        Y  V  S  C  I  R  L  *  I  I  C  *  *  *  L  *  T  I  R  S

14281 CTTGTACAGTATGATTTTACTGATTATAAGTTAGAATTGTTTAATAAGTATTTTAAGTAT 14340
      L  V  Q  Y  D  F  T  D  Y  K  L  E  L  F  N  K  Y  F  K  Y
       L  Y  S  M  I  L  L  I  I  S  *  N  C  L  I  S  I  L  S  I
        C  T  V  *  F  Y  *  L  *  V  R  I  V  *  *  V  F  *  V  L

14341 TGGGGTATGAAGTATCATCCTAATACTGTGGATTGTGATAATGATAGGTGTATTATTCAT 14400
      W  G  M  K  Y  H  P  N  T  V  D  C  D  N  D  R  C  I  I  H
       G  V  *  S  I  I  L  I  L  W  I  V  I  M  I  G  V  L  F  I
        G  Y  E  V  S  S  *  Y  C  G  L  *  *  *  *  V  Y  Y  S  L

14401 TGTGCTAATTTTAATATATTATTTAGTATGGTCTTACCTAATACTTGTTTTGGTCCTCTT 14460
      C  A  N  F  N  I  L  F  S  M  V  L  P  N  T  C  F  G  P  L
       V  L  I  L  I  Y  Y  L  V  W  S  Y  L  I  L  V  L  V  L  L
        C  *  F  *  Y  I  I  *  Y  G  L  T  *  Y  L  F  W  S  S  C

14461 GTTAGACAAATTTTTGTAGATGGTGTTCCGTTTGTTGTTTCAATTGGTTACCATTATAAA 14520
      V  R  Q  I  F  V  D  G  V  P  F  V  V  S  I  G  Y  H  Y  K
       L  D  K  F  L  *  M  V  F  R  L  L  F  Q  L  V  T  I  I  K
        *  T  N  F  C  R  W  C  S  V  C  C  F  N  W  L  P  L  *  R

14521 GAGTTAGGTGTAGTTATGAACTTGGATGTTGATACACACCGCTATCGTTTGTCTCTTAAA 14580
      E  L  G  V  V  M  N  L  D  V  D  T  H  R  Y  R  L  S  L  K
       S  *  V  *  L  *  T  W  M  L  I  H  T  A  I  V  C  L  L  K
        V  R  C  S  Y  E  L  G  C  *  Y  T  P  L  S  F  V  S  *  R
```

FIG. 9 CONT.

```
14581 GACTTACTTCTTTATGCAGCAGATCCTGCTATGCATGTTGCATCTGCTAGTGCTCTGCTT 14640
      D  L  L  L  Y  A  A  D  P  A  M  H  V  A  S  A  S  A  L  L
       T  Y  F  F  M  Q  Q  I  L  L  C  M  L  H  L  L  V  L  C  L
        L  T  S  L  C  S  R  S  C  Y  A  C  C  I  C  *  C  S  A  *

14641 GATTTACGAACTTGTTGTTTTAGTGTAGCTGCCATTACAAGTGGTATAAAGTTTCAAACT 14700
      D  L  R  T  C  C  F  S  V  A  A  I  T  S  G  I  K  F  Q  T
       I  Y  E  L  V  V  L  V  *  L  P  L  Q  V  V  *  S  F  K  L
        F  T  N  L  L  F  *  C  S  C  H  Y  K  W  Y  K  V  S  N  C

14701 GTTAAACCAGGTAATTTTAACCAAGATTTTTATGAGTTTGTCAAAAGTAAAGGCTTGTTT 14760
      V  K  P  G  N  F  N  Q  D  F  Y  E  F  V  K  S  K  G  L  F
       L  N  Q  V  I  L  T  K  I  F  M  S  L  S  K  V  K  A  C  L
        *  T  R  *  F  *  P  R  F  L  *  V  C  Q  K  *  R  L  V  *

14761 AAAGAGGGTAGTACAGTTGATTTGAAACACTTTTTCTTTACTCAAGATGGTAATGCTGCA 14820
      K  E  G  S  T  V  D  L  K  H  F  F  F  T  Q  D  G  N  A  A
       K  R  V  V  Q  L  I  *  N  T  F  S  L  L  K  M  V  M  L  Q
        R  G  *  Y  S  *  F  E  T  L  F  L  Y  S  R  W  *  C  C  N

14821 ATTACTGATTATAATTATTATAAGTATAATTTACCTACTATGGTTGATATTAAGCAGTTA 14880
      I  T  D  Y  N  Y  Y  K  Y  N  L  P  T  M  V  D  I  K  Q  L
       L  L  I  I  I  I  I  S  I  I  Y  L  L  W  L  I  L  S  S  Y
        Y  *  L  *  L  L  *  V  *  F  T  Y  Y  G  *  Y  *  A  V  I

14881 TTGTTTGTATTAGAAGTTGTTTATAAGTATTTTGAAATTTATGATGGTGGTTGTATACCA 14940
      L  F  V  L  E  V  V  Y  K  Y  F  E  I  Y  D  G  G  C  I  P
       C  L  Y  *  K  L  F  I  S  I  L  K  F  M  M  V  V  V  Y  Q
        V  C  I  R  S  C  L  *  V  F  *  N  L  *  W  W  L  Y  T  S

14941 GCATCACAAGTTATTGTTAATAATTATGACAAAAGTGCTGGTTATCCATTTAATAAATTT 15000
      A  S  Q  V  I  V  N  N  Y  D  K  S  A  G  Y  P  F  N  K  F
       H  H  K  L  L  L  I  I  M  T  K  V  L  V  I  H  L  I  N  L
        I  T  S  Y  C  *  *  L  *  Q  K  C  W  L  S  I  *  *  I  W

15001 GGTAAAGCTAGACTTTATTATGAGGCATTATCATTTGAGGAGCAGAATGAAATTTATGCA 15060
      G  K  A  R  L  Y  Y  E  A  L  S  F  E  E  Q  N  E  I  Y  A
       V  K  L  D  F  I  M  R  H  Y  H  L  R  S  R  M  K  F  M  H
        *  S  *  T  L  L  *  G  I  I  I  *  G  A  E  *  N  L  C  I

15061 TATACTAAACGTAATGTGTTGCCCACTTTAACTCAAATGAATTTAAAATATGCTATTAGT 15120
      Y  T  K  R  N  V  L  P  T  L  T  Q  M  N  L  K  Y  A  I  S
       I  L  N  V  M  C  C  P  L  *  L  K  *  I  *  N  M  L  L  V
        Y  *  T  *  C  V  A  H  F  N  S  N  E  F  K  I  C  Y  *  C
```

FIG. 9 CONT.

```
15121 GCTAAGAATAGAGCTCGTACTGTTGCAGGTGTTTCCATTCTTAGTACTATGACAGGTCGA 15180
      A  K  N  R  A  R  T  V  A  G  V  S  I  L  S  T  M  T  G  R
       L  R  I  E  L  V  L  L  Q  V  F  P  F  L  V  L  *  Q  V  E
        *  E  *  S  S  Y  C  C  R  C  F  H  S  *  Y  Y  D  R  S  N

15181 ATGTTTCATCAAAAATGTTTGAAGAGTATAGCAGCTACTCGTGGTGTTCCTGTTGTTATA 15240
      M  F  H  Q  K  C  L  K  S  I  A  A  T  R  G  V  P  V  V  I
       C  F  I  K  N  V  *  R  V  *  Q  L  L  V  V  F  L  L  L  *
        V  S  S  K  M  F  E  E  Y  S  S  Y  S  W  C  S  C  C  Y  R

15241 GGAACTACTAAATTTTATGGTGGCTGGGATGATATGTTACGCCATCTTATAAAGGATGTT 15300
      G  T  T  K  F  Y  G  G  W  D  D  M  L  R  H  L  I  K  D  V
       E  L  L  N  F  M  V  A  G  M  I  C  Y  A  I  L  *  R  M  L
        N  Y  *  I  L  W  W  L  G  *  Y  V  T  P  S  Y  K  G  C  *

15301 GACAACCCTGTTCTTATGGGTTGGGATTATCCTAAATGTGATCGTGCCATGCCAAATATT 15360
      D  N  P  V  L  M  G  W  D  Y  P  K  C  D  R  A  M  P  N  I
       T  T  L  F  L  W  V  G  I  I  L  N  V  I  V  P  C  Q  I  F
        Q  P  C  S  Y  G  L  G  L  S  *  M  *  S  C  H  A  K  Y  F

15361 TTGCGTATTGTTAGTAGTTTAGTTTTGGCTCGTAAACATGAATTTTGTTGTTCACATGGT 15420
      L  R  I  V  S  S  L  V  L  A  R  K  H  E  F  C  C  S  H  G
       C  V  L  L  V  V  *  F  W  L  V  N  M  N  F  V  V  H  M  V
        A  Y  C  *  *  F  S  F  G  S  *  T  *  I  L  L  F  T  W  *

15421 GATAGATTCTATCGCCTTGCGAATGAATGTGCTCAAGTTTTGAGTGAAATAGTTATGTGT 15480
      D  R  F  Y  R  L  A  N  E  C  A  Q  V  L  S  E  I  V  M  C
       I  D  S  I  A  L  R  M  N  V  L  K  F  *  V  K  *  L  C  V
        *  I  L  S  P  C  E  *  M  C  S  S  F  E  *  N  S  Y  V  W

15481 GGCGGTTGCTATTATGTTAAGCCTGGTGGTACTAGCAGTGGTGATGCAACCACTGCTTTT 15540
      G  G  C  Y  Y  V  K  P  G  G  T  S  S  G  D  A  T  T  A  F
       A  V  A  I  M  L  S  L  V  V  L  A  V  V  M  Q  P  L  L  L
        R  L  L  L  C  *  A  W  W  Y  *  Q  W  *  C  N  H  C  F  C

15541 GCTAACTCTGTTTTTAATATATGTCAAGCTGTTACTGCTAATGTTTGTTCTCTTATGGCT 15600
      A  N  S  V  F  N  I  C  Q  A  V  T  A  N  V  C  S  L  M  A
       L  T  L  F  L  I  Y  V  K  L  L  L  L  M  F  V  L  L  W  L
        *  L  C  F  *  Y  M  S  S  C  Y  C  *  C  L  F  S  Y  G  L

15601 TGTAATGGCCATAAGATTGAAGATTTAAGTATACGCAATTTACAAAAACGCTTATACTCT 15660
      C  N  G  H  K  I  E  D  L  S  I  R  N  L  Q  K  R  L  Y  S
       V  M  A  I  R  L  K  I  *  V  Y  A  I  Y  K  N  A  Y  T  L
        *  W  P  *  D  *  R  F  K  Y  T  Q  F  T  K  T  L  I  L  *
```

FIG. 9 CONT.

```
15661 AATGTTTATCGTACAGATTATGTTGATTATACATTTGTTAATGAGTATTATGAATTTTTA 15720
      N  V  Y  R  T  D  Y  V  D  Y  T  F  V  N  E  Y  Y  E  F  L
       M  F  I  V  Q  I  M  L  I  I  H  L  L  M  S  I  M  N  F  Y
        C  L  S  Y  R  L  C  *  L  Y  I  C  *  *  V  L  *  I  F  M

15721 TGTAAGCATTTTAGTATGATGATTTTGAGTGATGATGGTGTTGTTTGTTATAACTCTGAT 15780
      C  K  H  F  S  M  M  I  L  S  D  D  G  V  V  C  Y  N  S  D
       V  S  I  L  V  *  *  F  *  V  M  M  V  L  F  V  I  T  L  I
        *  A  F  *  Y  D  D  F  E  *  *  W  C  C  L  L  *  L  *  L

15781 TATGCTAGTAAGGGTTATATAGCCAATATAAGTGTTTTTCAACAAGTTTTGTACTATCAG 15840
      Y  A  S  K  G  Y  I  A  N  I  S  V  F  Q  Q  V  L  Y  Y  Q
       M  L  V  R  V  I  *  P  I  *  V  F  F  N  K  F  C  T  I  R
        C  *  *  G  L  Y  S  Q  Y  K  C  F  S  T  S  F  V  L  S  E

15841 AATAACGTTTTTATGTCTGAATCTAAATGTTGGGTTGAAAATGATATTACTAATGGTCCT 15900
      N  N  V  F  M  S  E  S  K  C  W  V  E  N  D  I  T  N  G  P
       I  T  F  L  C  L  N  L  N  V  G  L  K  M  I  L  L  M  V  L
        *  R  F  Y  V  *  I  *  M  L  G  *  K  *  Y  Y  *  W  S  S

15901 CATGAATTCTGTTCACAACATACTATGTTGGTTAAGATAGATGGTGACTATGTTTATCTA 15960
      H  E  F  C  S  Q  H  T  M  L  V  K  I  D  G  D  Y  V  Y  L
       M  N  S  V  H  N  I  L  C  W  L  R  *  M  V  T  M  F  I  Y
        *  I  L  F  T  T  Y  Y  V  G  *  D  R  W  *  L  C  L  S  T

15961 CCCTATCCAGACCCTTCTAGAATTTTAGGAGCTGGTTGTTTTGTTGATGATTTATTGAAG 16020
      P  Y  P  D  P  S  R  I  L  G  A  G  C  F  V  D  D  L  L  K
       P  I  Q  T  L  L  E  F  *  E  L  V  V  L  L  M  I  Y  *  R
        L  S  R  P  F  *  N  F  R  S  W  L  F  C  *  *  F  I  E  D

16021 ACTGACAGTGTTCTTTTGATAGAGCGCTTTGTAAGTCTAGCTATAGATGCTTACCCTTTA 16080
      T  D  S  V  L  L  I  E  R  F  V  S  L  A  I  D  A  Y  P  L
       L  T  V  F  F  *  *  S  A  L  *  V  *  L  *  M  L  T  L  *
        *  Q  C  S  F  D  R  A  L  C  K  S  S  Y  R  C  L  P  F  S

16081 GTACACCATGAAAATGAAGAATACCAAAAAGTTTTTCGTGTATATTTAGAATATATAAAA 16140
      V  H  H  E  N  E  E  Y  Q  K  V  F  R  V  Y  L  E  Y  I  K
       Y  T  M  K  M  K  N  T  K  K  F  F  V  Y  I  *  N  I  *  K
        T  P  *  K  *  R  I  P  K  S  F  S  C  I  F  R  I  Y  K  K

16141 AAACTATATAATGATCTTGGTAATCAGATCTTAGATAGTTATAGTGTTATTTTAAGTACT 16200
      K  L  Y  N  D  L  G  N  Q  I  L  D  S  Y  S  V  I  L  S  T
       N  Y  I  M  I  L  V  I  R  S  *  I  V  I  V  L  F  *  V  L
        T  I  *  *  S  W  *  S  D  L  R  *  L  *  C  Y  F  K  Y  L
```

FIG. 9 CONT.

```
16201 TGTGATGGTTTAAAGTTCACTGATGAATCATTTTATAAGAATATGTATTTAAAAAGTGCC 16260
      C  D  G  L  K  F  T  D  E  S  F  Y  K  N  M  Y  L  K  S  A
       V  M  V  *  S  S  L  M  N  H  F  I  R  I  C  I  *  K  V  P
        *  W  F  K  V  H  *  *  I  I  L  *  E  Y  V  F  K  K  C  R

16261 GTGATGCAGAGTGTAGGTGCATGTGTTGTTTGTTCATCACAGACGTCTTTGCGTTGTGGC 16320
      V  M  Q  S  V  G  A  C  V  V  C  S  S  Q  T  S  L  R  C  G
       *  C  R  V  *  V  H  V  L  F  V  H  H  R  R  L  C  V  V  A
        D  A  E  C  R  C  M  C  C  L  F  I  T  D  V  F  A  L  W  Q

16321 AGTTGTATACGGAAGCCTTTGTTGTGTTGTAAATGTTGCTATGATCATGTTATGGCAACC 16380
      S  C  I  R  K  P  L  L  C  C  K  C  C  Y  D  H  V  M  A  T
       V  V  Y  G  S  L  C  C  V  V  N  V  A  M  I  M  L  W  Q  P
        L  Y  T  E  A  F  V  V  L  *  M  L  L  *  S  C  Y  G  N  Q

16381 AATCATAAATATGTTTTGAGTGTTTCACCTTATGTGTGTAATGCACCTAACTGTGATGTG 16440
      N  H  K  Y  V  L  S  V  S  P  Y  V  C  N  A  P  N  C  D  V
       I  I  N  M  F  *  V  F  H  L  M  C  V  M  H  L  T  V  M  *
        S  *  I  C  F  E  C  F  T  L  C  V  *  C  T  *  L  *  C  E

16441 AGTGATGTCACCAAATTATATTTGGGTGGTATGTCTTATTATTGTGAAAACCATAAACCT 16500
      S  D  V  T  K  L  Y  L  G  G  M  S  Y  Y  C  E  N  H  K  P
       V  M  S  P  N  Y  I  W  V  V  C  L  I  I  V  K  T  I  N  L
        *  C  H  Q  I  I  F  G  W  Y  V  L  L  L  *  K  P  *  T  S

16501 CATTATTCATTTAAGTTAGTTATGAATGGTATGGTCTTTGGTTTGTATAAACAATCTTGT 16560
      H  Y  S  F  K  L  V  M  N  G  M  V  F  G  L  Y  K  Q  S  C
       I  I  H  L  S  *  L  *  M  V  W  S  L  V  C  I  N  N  L  V
        L  F  I  *  V  S  Y  E  W  Y  G  L  W  F  V  *  T  I  L  Y

16561 ACAGGTTCACCTTATATAGATGATTTTAATAAGATAGCTAGTTGTAAATGGACAGAAGTT 16620
      T  G  S  P  Y  I  D  D  F  N  K  I  A  S  C  K  W  T  E  V
       Q  V  H  L  I  *  M  I  L  I  R  *  L  V  V  N  G  Q  K  L
        R  F  T  L  Y  R  *  F  *  *  D  S  *  L  *  M  D  R  S  *

16621 GATGATTATGTTCTGGCAAATGAGTGTATTGAACGTTTAAAGTTATTTGCTGCAGAAACT 16680
      D  D  Y  V  L  A  N  E  C  I  E  R  L  K  L  F  A  A  E  T
       M  I  M  F  W  Q  M  S  V  L  N  V  *  S  Y  L  L  Q  K  L
        *  L  C  S  G  K  *  V  Y  *  T  F  K  V  I  C  C  R  N  S

16681 CAAAAGGCAACTGAAGAAGCTTTTAAACAAAGCTATGCTTCTGCTACTATTCAAGAGATT 16740
      Q  K  A  T  E  E  A  F  K  Q  S  Y  A  S  A  T  I  Q  E  I
       K  R  Q  L  K  K  L  L  N  K  A  M  L  L  L  L  F  K  R  L
        K  G  N  *  R  S  F  *  T  K  L  C  F  C  Y  Y  S  R  D  C
```

FIG. 9 CONT.

```
16741 GTTAGTGATAGAGAAATTATTTTGTGTTGGGAGACAGGTAAAGTTAAACCACCACTTAAT 16800
      V  S  D  R  E  I  I  L  C  W  E  T  G  K  V  K  P  P  L  N
       L  V  I  E  K  L  F  C  V  G  R  Q  V  K  L  N  H  H  L  I
        *  *  *  R  N  Y  F  V  L  G  D  R  *  S  *  T  T  T  *  *

16801 AAAAATTATGTTTTCACTGGCTATCATTTTACTAGTACTGGTAAGACAGTTTTAGGTGAG 16860
      K  N  Y  V  F  T  G  Y  H  F  T  S  T  G  K  T  V  L  G  E
       K  I  M  F  S  L  A  I  I  L  L  V  L  V  R  Q  F  *  V  S
        K  L  C  F  H  W  L  S  F  Y  *  Y  W  *  D  S  F  R  *  V

16861 TATGTTTTTGATAAAAGTGAATTAACTAATGGTGTTTATTATCGCGCTACAACTACTTAC 16920
      Y  V  F  D  K  S  E  L  T  N  G  V  Y  Y  R  A  T  T  T  Y
       M  F  L  I  K  V  N  *  L  M  V  F  I  I  A  L  Q  L  L  T
        C  F  *  *  K  *  I  N  *  W  C  L  L  S  R  Y  N  Y  L  Q

16921 AAACTTTCTATAGGTGATGTTTTTGTCTTAACATCACATTCTGTAGCTAATCTAAGTGCA 16980
      K  L  S  I  G  D  V  F  V  L  T  S  H  S  V  A  N  L  S  A
       N  F  L  *  V  M  F  L  S  *  H  H  I  L  *  L  I  *  V  H
        T  F  Y  R  *  C  F  C  L  N  I  T  F  C  S  *  S  K  C  T

16981 CCTACACTTGTTCCACAAGAGAACTATGCTAGTATAAGATTTTCTAGTGTTTATAGCGTT 17040
      P  T  L  V  P  Q  E  N  Y  A  S  I  R  F  S  S  V  Y  S  V
       L  H  L  F  H  K  R  T  M  L  V  *  D  F  L  V  F  I  A  F
        Y  T  C  S  T  R  E  L  C  *  Y  K  I  F  *  C  L  *  R  S

17041 CCTTTGCTGTTTCAAACTAATGTTGCTAACTATCAGCACATTGGAATGAAACGTTATTGC 17100
      P  L  L  F  Q  T  N  V  A  N  Y  Q  H  I  G  M  K  R  Y  C
       L  C  C  F  K  L  M  L  L  T  I  S  T  L  E  *  N  V  I  A
        F  A  V  S  N  *  C  C  *  L  S  A  H  W  N  E  T  L  L  H

17101 ACTGTGCAAGGTCCTCCTGGTACGGGCAAGTCTCACCTTGCTATAGGTTTAGCTGTTTAT 17160
      T  V  Q  G  P  P  G  T  G  K  S  H  L  A  I  G  L  A  V  Y
       L  C  K  V  L  L  V  R  A  S  L  T  L  L  *  V  *  L  F  I
        C  A  R  S  S  W  Y  G  Q  V  S  P  C  Y  R  F  S  C  L  L

17161 TACTATACAGCACGTGTAGTTTATACTGCTGCTAGTCATGCTGCTGTAGATGCATTGTGT 17220
      Y  Y  T  A  R  V  V  Y  T  A  A  S  H  A  A  V  D  A  L  C
       T  I  Q  H  V  *  F  I  L  L  L  V  M  L  L  *  M  H  C  V
        L  Y  S  T  C  S  L  Y  C  C  *  S  C  C  C  R  C  I  V  *

17221 GAAAAAGCTTATAAGTTTTTAAATATTAATGACTGTACACGCATTATACCTGCTAAAGTT 17280
      E  K  A  Y  K  F  L  N  I  N  D  C  T  R  I  I  P  A  K  V
       K  K  L  I  S  F  *  I  L  M  T  V  H  A  L  Y  L  L  K  F
        K  S  L  *  V  F  K  Y  *  *  L  Y  T  H  Y  T  C  *  S  S
```

FIG. 9 CONT.

```
17281 CGTGTAGATTGTTATGATAAGTTTAAAATTAATGATACTACTTGTAAGTATGTTTTTACT 17340
      R  V  D  C  Y  D  K  F  K  I  N  D  T  T  C  K  Y  V  F  T
       V  *  I  V  M  I  S  L  K  L  M  I  L  L  V  S  M  F  L  L
        C  R  L  L  *  *  V  *  N  *  *  Y  Y  L  *  V  C  F  Y  Y

17341 ACAATAAATGCATTACCAGAGTTAGTCACAGATATTGTTGTTGTTGATGAAGTTAGTATG 17400
      T  I  N  A  L  P  E  L  V  T  D  I  V  V  V  D  E  V  S  M
       Q  *  M  H  Y  Q  S  *  S  Q  I  L  L  L  L  M  K  L  V  C
        N  K  C  I  T  R  V  S  H  R  Y  C  C  C  *  *  S  *  Y  A

17401 CTTACTAATTATGAATTGTCTGTTATAAATGCTCGTGTTAAAGCTAAACATTATGTATAT 17460
      L  T  N  Y  E  L  S  V  I  N  A  R  V  K  A  K  H  Y  V  Y
       L  L  I  M  N  C  L  L  *  M  L  V  L  K  L  N  I  M  Y  I
        Y  *  L  *  I  V  C  Y  K  C  S  C  *  S  *  T  L  C  I  Y

17461 ATTGGAGATCCTGCTCAGTTACCTGCACCACGTGTGCTATTGAGTAAGGGTTCTTTAGAA 17520
      I  G  D  P  A  Q  L  P  A  P  R  V  L  L  S  K  G  S  L  E
       L  E  I  L  L  S  Y  L  H  H  V  C  Y  *  V  R  V  L  *  N
        W  R  S  C  S  V  T  C  T  T  C  A  I  E  *  G  F  F  R  T

17521 CCTAGGCATTTTAATTCTATTACTAAAATAATGTGCTGTTTAGGTCCTGATATTTTTTTG 17580
      P  R  H  F  N  S  I  T  K  I  M  C  C  L  G  P  D  I  F  L
       L  G  I  L  I  L  L  L  K  *  C  A  V  *  V  L  I  F  F  W
        *  A  F  *  F  Y  Y  *  N  N  V  L  F  R  S  *  Y  F  F  G

17581 GGAAATTGTTATAGATGTCCTAAAGAAATTGTAGAAACTGTTTCAGCATTGGTTTATGAT 17640
      G  N  C  Y  R  C  P  K  E  I  V  E  T  V  S  A  L  V  Y  D
       E  I  V  I  D  V  L  K  K  L  *  K  L  F  Q  H  W  F  M  I
        K  L  L  *  M  S  *  R  N  C  R  N  C  F  S  I  G  L  *  *

17641 AATAAACTTAAGGCTAAGAATGATAATAGTTCATTATGCTTTAAAGTATATTTTAAGGGA 17700
      N  K  L  K  A  K  N  D  N  S  S  L  C  F  K  V  Y  F  K  G
       I  N  L  R  L  R  M  I  I  V  H  Y  A  L  K  Y  I  L  R  D
        *  T  *  G  *  E  *  *  *  F  I  M  L  *  S  I  F  *  G  T

17701 CAGACAACACATGAGAGTTCAAGTGCTGTAAATATTCAACAAATATATTTAATTAGTAAA 17760
      Q  T  T  H  E  S  S  S  A  V  N  I  Q  Q  I  Y  L  I  S  K
       R  Q  H  M  R  V  Q  V  L  *  I  F  N  K  Y  I  *  L  V  N
        D  N  T  *  E  F  K  C  C  K  Y  S  T  N  I  F  N  *  *  I

17761 TTTTTGAAAGCTAATCCAGTTTGGAATAGTGCTGTTTTTATTAGTCCTTATAATAGTCAG 17820
      F  L  K  A  N  P  V  W  N  S  A  V  F  I  S  P  Y  N  S  Q
       F  *  K  L  I  Q  F  G  I  V  L  F  L  L  V  L  I  I  V  R
        F  E  S  *  S  S  L  E  *  C  C  F  Y  *  S  L  *  *  S  E
```

FIG. 9 CONT.

```
17821 AACTATGTTGCTAAGCGTATTTTAGGTGTTCAAACACAAACTGTTGATTCTGCTCAAGGT 17880
      N  Y  V  A  K  R  I  L  G  V  Q  T  Q  T  V  D  S  A  Q  G
       T  M  L  L  S  V  F  *  V  F  K  H  K  L  L  I  L  L  K  V
        L  C  C  *  A  Y  F  R  C  S  N  T  N  C  *  F  C  S  R  F

17881 TCTGAATATGATTATGTTATATATTCACAAACAGCAGAAACAGCTCATTCTATTAATGTT 17940
      S  E  Y  D  Y  V  I  Y  S  Q  T  A  E  T  A  H  S  I  N  V
       L  N  M  I  M  L  Y  I  H  K  Q  Q  K  Q  L  I  L  L  M  L
        *  I  *  L  C  Y  I  F  T  N  S  R  N  S  S  F  Y  *  C  *

17941 AATCGATTTAATGTTGCCATAACTAGAGCCAAGAAGGGTATTTTCTGTGTTATGAGTAAT 18000
      N  R  F  N  V  A  I  T  R  A  K  K  G  I  F  C  V  M  S  N
       I  D  L  M  L  P  *  L  E  P  R  R  V  F  S  V  L  *  V  I
        S  I  *  C  C  H  N  *  S  Q  E  G  Y  F  L  C  Y  E  *  Y

18001 ATGCAATTATTTGAATCTCTTAATTTTATTACTTTACCTTTAGATAAAATTCAGAATCAA 18060
      M  Q  L  F  E  S  L  N  F  I  T  L  P  L  D  K  I  Q  N  Q
       C  N  Y  L  N  L  L  I  L  L  L  Y  L  *  I  K  F  R  I  K
        A  I  I  *  I  S  *  F  Y  Y  F  T  F  R  *  N  S  E  S  N

18061 ACTTTATCTCGTTTGCATTGTACTACTAATCTTTTTAAAGATTGTAGTAAAAATTTTTTA 18120
      T  L  S  R  L  H  C  T  T  N  L  F  K  D  C  S  K  N  F  L
       L  Y  L  V  C  I  V  L  L  I  F  L  K  I  V  V  K  I  F  *
        F  I  S  F  A  L  Y  Y  *  S  F  *  R  L  *  *  K  F  F  R

18121 GGTTACCACCCAGCTCATGCTCCTTCATTTTTATCAGTTGATGATAAATATAAGGTCAAC 18180
      G  Y  H  P  A  H  A  P  S  F  L  S  V  D  D  K  Y  K  V  N
       V  T  T  Q  L  M  L  L  H  F  Y  Q  L  M  I  N  I  R  S  T
        L  P  P  S  S  C  S  F  I  F  I  S  *  *  *  I  *  G  Q  R

18181 GAAGATTTGGCTGTTTGTTTAAACATTTGTGAACCTGTTTTAACATATTCTCGTTTAATA 18240
      E  D  L  A  V  C  L  N  I  C  E  P  V  L  T  Y  S  R  L  I
       K  I  W  L  F  V  *  T  F  V  N  L  F  *  H  I  L  V  *  Y
        R  F  G  C  L  F  K  H  L  *  T  C  F  N  I  F  S  F  N  I

18241 TCTCTCATGGGGTTTAAATTGGATTTGACTCTTGATGGTTATTCTAAATTTTTTATTACT 18300
      S  L  M  G  F  K  L  D  L  T  L  D  G  Y  S  K  F  F  I  T
       L  S  W  G  L  N  W  I  *  L  L  M  V  I  L  N  F  L  L  L
        S  H  G  V  *  I  G  F  D  S  *  W  L  F  *  I  F  Y  Y  *

18301 AAAGACGAAGCTATTAAACGTGTTAGAGGTTGGGTTGGTTTTGATGTAGAAGGAGCCCAT 18360
      K  D  E  A  I  K  R  V  R  G  W  V  G  F  D  V  E  G  A  H
       K  T  K  L  L  N  V  L  E  V  G  L  V  L  M  *  K  E  P  M
        R  R  S  Y  *  T  C  *  R  L  G  W  F  *  C  R  R  S  P  C
```

FIG. 9 CONT.

```
18361 GCTACGCGTGACAACATTGGAACAAACTTTCCATTGCAAATAGGTTTTTCAACTGGTGTT 18420
      A  T  R  D  N  I  G  T  N  F  P  L  Q  I  G  F  S  T  G  V
       L  R  V  T  T  L  E  Q  T  F  H  C  K  *  V  F  Q  L  V  L
        Y  A  *  Q  H  W  N  K  L  S  I  A  N  R  F  F  N  W  C  *

18421 GATTTTGTAGTTGAAGCTACTGGCTTATTTGCTGAGAGAGATTGTTATATATTTAAAAGA 18480
      D  F  V  V  E  A  T  G  L  F  A  E  R  D  C  Y  I  F  K  R
       I  L  *  L  K  L  L  A  Y  L  L  R  E  I  V  I  Y  L  K  E
        F  C  S  *  S  Y  W  L  I  C  *  E  R  L  L  Y  I  *  K  N

18481 ACTGTTGCTAAAGCTCCTCCTGGTGATAACTTTAAACATTTAATACCCCTTATGTCGAAA 18540
      T  V  A  K  A  P  P  G  D  N  F  K  H  L  I  P  L  M  S  K
       L  L  L  K  L  L  L  V  I  T  L  N  I  *  Y  P  L  C  R  K
        C  C  *  S  S  S  W  *  *  L  *  T  F  N  T  P  Y  V  E  R

18541 GGTCAAAAGTGGGATGTTGTTAGAATCAGAATTGTTCAAATGTTGTCTGATTATCTTTTG 18600
      G  Q  K  W  D  V  V  R  I  R  I  V  Q  M  L  S  D  Y  L  L
       V  K  S  G  M  L  L  E  S  E  L  F  K  C  C  L  I  I  F  W
        S  K  V  G  C  C  *  N  Q  N  C  S  N  V  V  *  L  S  F  G

18601 GATCTTTCTGATAGTGTAGTATTTATTACTTGGTCTGCCAGTTTTGAACTTACGTGTTTA 18660
      D  L  S  D  S  V  V  F  I  T  W  S  A  S  F  E  L  T  C  L
       I  F  L  I  V  *  Y  L  L  L  G  L  P  V  L  N  L  R  V  *
        S  F  *  *  C  S  I  Y  Y  L  V  C  Q  F  *  T  Y  V  F  K

18661 AGGTATTTTGCTAAATTAGGTAGAGAGCTCAATTGTGATGTGTGTCCTAATCGTGCAACA 18720
      R  Y  F  A  K  L  G  R  E  L  N  C  D  V  C  P  N  R  A  T
       G  I  L  L  N  *  V  E  S  S  I  V  M  C  V  L  I  V  Q  H
        V  F  C  *  I  R  *  R  A  Q  L  *  C  V  S  *  S  C  N  M

18721 TGCTATAATTCTAGAACTGGTTATTACGGTTGTTGGCGCCATAGTTATACTTGTGATTAT 18780
      C  Y  N  S  R  T  G  Y  Y  G  C  W  R  H  S  Y  T  C  D  Y
       A  I  I  L  E  L  V  I  T  V  V  G  A  I  V  I  L  V  I  M
        L  *  F  *  N  W  L  L  R  L  L  A  P  *  L  Y  L  *  L  C

18781 GTGTATAACCCGCTTATTGTAGATATACAACAGTGGGGTTACACAGGTTCTTTAACTAGT 18840
      V  Y  N  P  L  I  V  D  I  Q  Q  W  G  Y  T  G  S  L  T  S
       C  I  T  R  L  L  *  I  Y  N  S  G  V  T  Q  V  L  *  L  V
        V  *  P  A  Y  C  R  Y  T  T  V  G  L  H  R  F  F  N  *  *

18841 AATCATGATATAATTTGTAATGTACATAAAGGTGCACATGTTGCATCATCTGATGCAATT 18900
      N  H  D  I  I  C  N  V  H  K  G  A  H  V  A  S  S  D  A  I
       I  M  I  *  F  V  M  Y  I  K  V  H  M  L  H  H  L  M  Q  L
        S  *  Y  N  L  *  C  T  *  R  C  T  C  C  I  I  *  C  N  Y
```

FIG. 9 CONT.

```
18901 ATGACTCGGTGTTTAGCAATCTATGATTGTTTTTGTAAATCTGTTAATTGGAATTTAGAG 18960
      M  T  R  C  L  A  I  Y  D  C  F  C  K  S  V  N  W  N  L  E
       *  L  G  V  *  Q  S  M  I  V  F  V  N  L  L  I  G  I  *  S
        D  S  V  F  S  N  L  *  L  F  L  *  I  C  *  L  E  F  R  V

18961 TATCCAATAATTTCCAATGAGGTTAGTATAAATACATCTTGTAGGTTATTGCAGCGTGTT 19020
      Y  P  I  I  S  N  E  V  S  I  N  T  S  C  R  L  L  Q  R  V
       I  Q  *  F  P  M  R  L  V  *  I  H  L  V  G  Y  C  S  V  L
        S  N  N  F  Q  *  G  *  Y  K  Y  I  L  *  V  I  A  A  C  Y

19021 ATGCTTAAAGCTGCCATGCTATGTAATAGATACAATTTATGTTATGACATTGGCAATCCT 19080
      M  L  K  A  A  M  L  C  N  R  Y  N  L  C  Y  D  I  G  N  P
       C  L  K  L  P  C  Y  V  I  D  T  I  Y  V  M  T  L  A  I  L
        A  *  S  C  H  A  M  *  *  I  Q  F  M  L  *  H  W  Q  S  *

19081 AAAGGTATTGCTTGTGTCAAAGATTATGAATTTAAATTCTATGATGCTTCTCCTGTTGTC 19140
      K  G  I  A  C  V  K  D  Y  E  F  K  F  Y  D  A  S  P  V  V
       K  V  L  L  V  S  K  I  M  N  L  N  S  M  M  L  L  L  L  S
        R  Y  C  L  C  Q  R  L  *  I  *  I  L  *  C  F  S  C  C  Q

19141 AAGTCTGTTAAACAGTTGTTTTATGTTTATGATGTTCATAAAGATAATTTTAAGGATGGT 19200
      K  S  V  K  Q  L  F  Y  V  Y  D  V  H  K  D  N  F  K  D  G
       S  L  L  N  S  C  F  M  F  M  M  F  I  K  I  I  L  R  M  V
        V  C  *  T  V  V  L  C  L  *  C  S  *  R  *  F  *  G  W  F

19201 TTATGTATGTTTTGGAATTGTAATGTTGATAAATATCCATCTAATTCAATTGTTTGTAGA 19260
      L  C  M  F  W  N  C  N  V  D  K  Y  P  S  N  S  I  V  C  R
       Y  V  C  F  G  I  V  M  L  I  N  I  H  L  I  Q  L  F  V  D
        M  Y  V  L  E  L  *  C  *  *  I  S  I  *  F  N  C  L  *  I

19261 TTTGATACTCGGGTATTAAATAAATTAAACCTCCCTGGATGTAATGGTGGTAGTTTGTAT 19320
      F  D  T  R  V  L  N  K  L  N  L  P  G  C  N  G  G  S  L  Y
       L  I  L  G  Y  *  I  N  *  T  S  L  D  V  M  V  V  V  C  M
        *  Y  S  G  I  K  *  I  K  P  P  W  M  *  W  W  *  F  V  C

19321 GTTAATAAACATGCATTTCATACTAATCCTTTTACCAGAACGGTCTTTGAAAATCTTAAA 19380
      V  N  K  H  A  F  H  T  N  P  F  T  R  T  V  F  E  N  L  K
       L  I  N  M  H  F  I  L  I  L  L  P  E  R  S  L  K  I  L  N
        *  *  T  C  I  S  Y  *  S  F  Y  Q  N  G  L  *  K  S  *  T

19381 CCTATGCCATTTTTTTACTATTCAGATACTCCTTGTGTGTATGTAGATGGTTTGGAATCC 19440
      P  M  P  F  F  Y  Y  S  D  T  P  C  V  Y  V  D  G  L  E  S
       L  C  H  F  F  T  I  Q  I  L  L  V  C  M  *  M  V  W  N  P
        Y  A  I  F  L  L  F  R  Y  S  L  C  V  C  R  W  F  G  I  Q
```

FIG. 9 CONT.

```
19441 AAACAAGTTGATTATGTGCCTTTAAGAAGCGCTACTTGTATCACACGATGTAATTTAGGT 19500
      K  Q  V  D  Y  V  P  L  R  S  A  T  C  I  T  R  C  N  L  G
       N  K  L  I  M  C  L  *  E  A  L  L  V  S  H  D  V  I  *  V
        T  S  *  L  C  A  F  K  K  R  Y  L  Y  H  T  M  *  F  R  W

19501 GGTGCTGTTTGTTCTAAGCATGCTGAAGATTATTGTAAATATCTTGAGTCTTATAATGTA 19560
      G  A  V  C  S  K  H  A  E  D  Y  C  K  Y  L  E  S  Y  N  V
       V  L  F  V  L  S  M  L  K  I  I  V  N  I  L  S  L  I  M  *
        C  C  L  F  *  A  C  *  R  L  L  *  I  S  *  V  L  *  C  S

19561 GCTACTACAGCAGGCTTTACTTTTTGGGTTTATAAGACTTTTGATTTTTATAATTTATGG 19620
      A  T  T  A  G  F  T  F  W  V  Y  K  T  F  D  F  Y  N  L  W
       L  L  Q  Q  A  L  L  F  G  F  I  R  L  L  I  F  I  I  Y  G
        Y  Y  S  R  L  Y  F  L  G  L  *  D  F  *  F  L  *  F  M  E

19621 AATACTTTCACTATGTTGCAGAGCTTAGAAAATGTAATATATAATTTGGTTAATGCTGGT 19680
      N  T  F  T  M  L  Q  S  L  E  N  V  I  Y  N  L  V  N  A  G
       I  L  S  L  C  C  R  A  *  K  M  *  Y  I  I  W  L  M  L  V
        Y  F  H  Y  V  A  E  L  R  K  C  N  I  *  F  G  *  C  W  S

19681 CATTATGATGGACGTATAGGTGAATTGCCTTGTGCTATTATGAATGACAAAGTTGTTGTT 19740
      H  Y  D  G  R  I  G  E  L  P  C  A  I  M  N  D  K  V  V  V
       I  M  M  D  V  *  V  N  C  L  V  L  L  *  M  T  K  L  L  L
        L  *  W  T  Y  R  *  I  A  L  C  Y  Y  E  *  Q  S  C  C  *

19741 AAGATTAATAATGTAGATACTGTTATTTTTAAAAATAATACATCACTTCCTACTAATATA 19800
      K  I  N  N  V  D  T  V  I  F  K  N  N  T  S  L  P  T  N  I
       R  L  I  M  *  I  L  L  F  L  K  I  I  H  H  F  L  L  I  *
        D  *  *  C  R  Y  C  Y  F  *  K  *  Y  I  T  S  Y  *  Y  S

19801 GCTGTTGAATTATTTACAAAACGTAGTATTCGCCATCACCCTGAACTTAAGATTCTTAGA 19860
      A  V  E  L  F  T  K  R  S  I  R  H  H  P  E  L  K  I  L  R
       L  L  N  Y  L  Q  N  V  V  F  A  I  T  L  N  L  R  F  L  E
        C  *  I  I  Y  K  T  *  Y  S  P  S  P  *  T  *  D  S  *  K

19861 AATTTGAATATTGATATTTGTTGGAAGCATGTCCTTTGGGATTATGTTAAAGATAGTTTG 19920
      N  L  N  I  D  I  C  W  K  H  V  L  W  D  Y  V  K  D  S  L
       I  *  I  L  I  F  V  G  S  M  S  F  G  I  M  L  K  I  V  C
        F  E  Y  *  Y  L  L  E  A  C  P  L  G  L  C  *  R  *  F  V

19921 TTTTGTAGTTCTACCTATGGTGTCTGCAAATACACAGATTTAAATTTTATTGAAAATTTG 19980
      F  C  S  S  T  Y  G  V  C  K  Y  T  D  L  N  F  I  E  N  L
       F  V  V  L  P  M  V  S  A  N  T  Q  I  *  I  L  L  K  I  *
        L  *  F  Y  L  W  C  L  Q  I  H  R  F  K  F  Y  *  K  F  E
```

FIG. 9 CONT.

```
19981 AATGTACTTTTTGATGGTCGTGACAATGGTGCTTTAGAAGCTTTTAGAAAAGCAAGAAAT 20040
      N  V  L  F  D  G  R  D  N  G  A  L  E  A  F  R  K  A  R  N
       M  Y  F  L  M  V  V  T  M  V  L  *  K  L  L  E  K  Q  E  M
        C  T  F  *  W  S  *  Q  W  C  F  R  S  F  *  K  S  K  K  W

20041 GGTGTTTTTATTAGTACTGGAAAATTAAGTAGTTTGTCTATGATTAAAGGTCCGCAACGA 20100
      G  V  F  I  S  T  G  K  L  S  S  L  S  M  I  K  G  P  Q  R
       V  F  L  L  V  L  E  N  *  V  V  C  L  *  L  K  V  R  N  E
        C  F  Y  *  Y  W  K  I  K  *  F  V  Y  D  *  R  S  A  T  S

20101 GCTGATTTAAATGGCGTAATTGTGGATAAAGTTGGAGAACTCAATGTTGAGTTTTGGTTT 20160
      A  D  L  N  G  V  I  V  D  K  V  G  E  L  N  V  E  F  W  F
       L  I  *  M  A  *  L  W  I  K  L  E  N  S  M  L  S  F  G  L
        *  F  K  W  R  N  C  G  *  S  W  R  T  Q  C  *  V  L  V  C

20161 GCTATGAGAAAAGATGGTGACGATGTTATCTTCAGCCGTGCAGACAGCCTAAGCCCAAGC 20220
      A  M  R  K  D  G  D  D  V  I  F  S  R  A  D  S  L  S  P  S
       L  *  E  K  M  V  T  M  L  S  S  A  V  Q  T  A  *  A  Q  A
        Y  E  K  R  W  *  R  C  Y  L  Q  P  C  R  Q  P  K  P  K  P

20221 CATTACTGGAGCCCACAAGGTAATCTAGGTGGTAATTGTGCAGGTAATGCCAGCGGTAAT 20280
      H  Y  W  S  P  Q  G  N  L  G  G  N  C  A  G  N  A  S  G  N
       I  T  G  A  H  K  V  I  *  V  V  I  V  Q  V  M  P  A  V  M
        L  L  E  P  T  R  *  S  R  W  *  L  C  R  *  C  Q  R  *  *

20281 GATGCTCTAGCGCGTTTTACTATCTTTACTCAGAGTCGTGTATTGTCAACCTTTGAACCT 20340
      D  A  L  A  R  F  T  I  F  T  Q  S  R  V  L  S  T  F  E  P
       M  L  *  R  V  L  L  S  L  L  R  V  V  Y  C  Q  P  L  N  L
        C  S  S  A  F  Y  Y  L  Y  S  E  S  C  I  V  N  L  *  T  S

20341 CGCTCAGATTTAGAACGGGATTTTATTGATATGGAGGATAGTCTGTTTATAGCCAAATAT 20400
      R  S  D  L  E  R  D  F  I  D  M  E  D  S  L  F  I  A  K  Y
       A  Q  I  *  N  G  I  L  L  I  W  R  I  V  C  L  *  P  N  M
        L  R  F  R  T  G  F  Y  *  Y  G  G  *  S  V  Y  S  Q  I  W

20401 GGTTTAGAAGATTATGCATTTGATCATATAGTTTATGGTAGTTTTAATTATAAAGTTATA 20460
      G  L  E  D  Y  A  F  D  H  I  V  Y  G  S  F  N  Y  K  V  I
       V  *  K  I  M  H  L  I  I  *  F  M  V  V  L  I  I  K  L  *
        F  R  R  L  C  I  *  S  Y  S  L  W  *  F  *  L  *  S  Y  R

20461 GGAGGTTTGCACTTGCTTATAGGTTTATTTCGTAGACTAAAAAAATCTAATTTGGTAATT 20520
      G  G  L  H  L  L  I  G  L  F  R  R  L  K  K  S  N  L  V  I
       E  V  C  T  C  L  *  V  Y  F  V  D  *  K  N  L  I  W  *  F
        R  F  A  L  A  Y  R  F  I  S  *  T  K  K  I  *  F  G  N  S
```

FIG. 9 CONT.

```
20521 CAAGAGTTTTTGCAGTATGATTCTAGTATTCATTCATATTTCATTACTGATCAAGAGTGT 20580
      Q  E  F  L  Q  Y  D  S  S  I  H  S  Y  F  I  T  D  Q  E  C
       K  S  F  C  S  M  I  L  V  F  I  H  I  S  L  L  I  K  S  V
        R  V  F  A  V  *  F  *  Y  S  F  I  F  H  Y  *  S  R  V  W

20581 GGTAGTAGTAAGAGTGTTTGTACAGTTATTGATTTATTATTAGATGACTTTGTTGTTATT 20640
      G  S  S  K  S  V  C  T  V  I  D  L  L  L  D  D  F  V  V  I
       V  V  V  R  V  F  V  Q  L  L  I  Y  Y  *  M  T  L  L  L  L
        *  *  *  E  C  L  Y  S  Y  *  F  I  I  R  *  L  C  C  Y  C

20641 GTTAAGTCATTAAATTTGAATTGTGTTAGTAAAGTTGTTAATATTAATGTTGACTTTAAG 20700
      V  K  S  L  N  L  N  C  V  S  K  V  V  N  I  N  V  D  F  K
       L  S  H  *  I  *  I  V  L  V  K  L  L  I  L  M  L  T  L  R
        *  V  I  K  F  E  L  C  *  *  S  C  *  Y  *  C  *  L  *  G

20701 GACTTTCAATTTATGTTGTGGTGTAATGATAATAAAATTATGACTTTTTATCCTAAAATG 20760
      D  F  Q  F  M  L  W  C  N  D  N  K  I  M  T  F  Y  P  K  M
       T  F  N  L  C  C  G  V  M  I  I  K  L  *  L  F  I  L  K  C
        L  S  I  Y  V  V  V  *  *  *  *  N  Y  D  F  L  S  *  N  A

20761 CAAGCTACTAGTGACTGGAAACCTGGTTATTCTATGCCTGTTTTATATAAGTATTTGAAT 20820
      Q  A  T  S  D  W  K  P  G  Y  S  M  P  V  L  Y  K  Y  L  N
       K  L  L  V  T  G  N  L  V  I  L  C  L  F  Y  I  S  I  *  M
        S  Y  *  *  L  E  T  W  L  F  Y  A  C  F  I  *  V  F  E  C

20821 GTTCCATTAGAGAGAGTTTCTTTATGGAATTATGGTAAAGCTATTAATTTACCAACAGGT 20880
      V  P  L  E  R  V  S  L  W  N  Y  G  K  A  I  N  L  P  T  G
       F  H  *  R  E  F  L  Y  G  I  M  V  K  L  L  I  Y  Q  Q  V
        S  I  R  E  S  F  F  M  E  L  W  *  S  Y  *  F  T  N  R  L

20881 TGTATGATGAATGTTGCTAAGTATACTCAATTATGTCAGTATTTAAATACTACAACATTA 20940
      C  M  M  N  V  A  K  Y  T  Q  L  C  Q  Y  L  N  T  T  T  L
       V  *  *  M  L  L  S  I  L  N  Y  V  S  I  *  I  L  Q  H  *
        Y  D  E  C  C  *  V  Y  S  I  M  S  V  F  K  Y  Y  N  I  S

20941 GCTGTTCCTGTTAATATGCGTGTCTTACACTTAGGTGCAGGATCTGATAAAGAAGTAGCC 21000
      A  V  P  V  N  M  R  V  L  H  L  G  A  G  S  D  K  E  V  A
       L  F  L  L  I  C  V  S  Y  T  *  V  Q  D  L  I  K  K  *  P
        C  S  C  *  Y  A  C  L  T  L  R  C  R  I  *  *  R  S  S  P

21001 CCTGGTTCTGCTGTTTTAAGACAGTGGTTACCATCTGGTAGTATTCTTGTAGATAATGAT 21060
      P  G  S  A  V  L  R  Q  W  L  P  S  G  S  I  L  V  D  N  D
       L  V  L  L  F  *  D  S  G  Y  H  L  V  V  F  L  *  I  M  I
        W  F  C  C  F  K  T  V  V  T  I  W  *  Y  S  C  R  *  *  F
```

FIG. 9 CONT.

```
21061 TTAAATCCTTTTGTTAGTGATAGTTTAGTCACTTATTTTGGAGATTGTATGACTTTACCA 21120
      L  N  P  F  V  S  D  S  L  V  T  Y  F  G  D  C  M  T  L  P
       *  I  L  L  L  V  I  V  *  S  L  I  L  E  I  V  *  L  Y  H
        K  S  F  C  *  *  *  F  S  H  L  F  W  R  L  Y  D  F  T  I

21121 TTTGATTGTCATTGGGATCTGATAATATCTGATATGTATGATCCTCTTACTAAGAATATT 21180
      F  D  C  H  W  D  L  I  I  S  D  M  Y  D  P  L  T  K  N  I
       L  I  V  I  G  I  *  *  Y  L  I  C  M  I  L  L  L  R  I  L
        *  L  S  L  G  S  D  N  I  *  Y  V  *  S  S  Y  *  E  Y  W

21181 GGTGATTATAATGTGAGTAAGGATGGTTTCTTTACTTATATTTGTTATTTAATTCGTGAT 21240
      G  D  Y  N  V  S  K  D  G  F  F  T  Y  I  C  Y  L  I  R  D
       V  I  I  M  *  V  R  M  V  S  L  L  I  F  V  I  *  F  V  I
        *  L  *  C  E  *  G  W  F  L  Y  L  Y  L  L  F  N  S  *  *

21241 AAATTATCTTTGGGTGGTAGTGTTGCTATAAAAATTACAGAATTTTCTTGGAATGCTGAC 21300
      K  L  S  L  G  G  S  V  A  I  K  I  T  E  F  S  W  N  A  D
       N  Y  L  W  V  V  V  L  L  *  K  L  Q  N  F  L  G  M  L  T
        I  I  F  G  W  *  C  C  Y  K  N  Y  R  I  F  L  E  C  *  L

21301 TTATATAAATTAATGAGTTATTTTGCATTCTGGACAGTTTTTTGTACTAATGTAAATGCT 21360
      L  Y  K  L  M  S  Y  F  A  F  W  T  V  F  C  T  N  V  N  A
       Y  I  N  *  *  V  I  L  H  S  G  Q  F  F  V  L  M  *  M  L
        I  *  I  N  E  L  F  C  I  L  D  S  F  L  Y  *  C  K  C  F

21361 TCTTCTAGTGAAGGGTTTTTAATAGGTATAAATTATTTGGGTAAGTCCTGCTTTGAAATA 21420
      S  S  S  E  G  F  L  I  G  I  N  Y  L  G  K  S  C  F  E  I
       L  L  V  K  G  F  *  *  V  *  I  I  W  V  S  P  A  L  K  *
        F  *  *  R  V  F  N  R  Y  K  L  F  G  *  V  L  L  *  N  R

21421 GATGGCAATGTTATGCATGCCAACTATTTGTTTTGGAGAAATAGTACAACATGGAATGGT 21480
      D  G  N  V  M  H  A  N  Y  L  F  W  R  N  S  T  T  W  N  G
       M  A  M  L  C  M  P  T  I  C  F  G  E  I  V  Q  H  G  M  V
        W  Q  C  Y  A  C  Q  L  F  V  L  E  K  *  Y  N  M  E  W  W

21481 GGTGCTTATAGTTTATTTGATATGTCTAAATTTTCTTTGAAATTGGCTGGCACTGCTGTA 21540
      G  A  Y  S  L  F  D  M  S  K  F  S  L  K  L  A  G  T  A  V
       V  L  I  V  Y  L  I  C  L  N  F  L  *  N  W  L  A  L  L  *
        C  L  *  F  I  *  Y  V  *  I  F  F  E  I  G  W  H  C  C  S

21541 GTAAATTTAAGACCAGATCAATTAAATGATTTAGTTTATTCTCTTATTGAAAGAGGTAAG 21600
      V  N  L  R  P  D  Q  L  N  D  L  V  Y  S  L  I  E  R  G  K
       *  I  *  D  Q  I  N  *  M  I  *  F  I  L  L  L  K  E  V  S
        K  F  K  T  R  S  I  K  *  F  S  L  F  S  Y  *  K  R  *  V
```

FIG. 9 CONT.

```
21601 TTATTAGTGCGTGATACGCGTAAAGAAATTTTTGTTGGTGATAGTCTTGTAAACACTTGT 21660
       L  L  V  R  D  T  R  K  E  I  F  V  G  D  S  L  V  N  T  C
        Y  *  C  V  I  R  V  K  K  F  L  L  V  I  V  L  *  T  L  V
         I  S  A  *  Y  A  *  R  N  F  C  W  *  *  S  C  K  H  L  L

21661 TAGATCTTTCAGTTTGTTAATATTAAATCTAAACTATGTTAATTATATTTTTATTTTTTA 21720
       *  I  F  Q  F  V  N  I  K  S  K  L  C  *  L  Y  F  Y  F  L
        R  S  F  S  L  L  I  L  N  L  N  Y  V  N  Y  I  F  I  F  *
         D  L  S  V  C  *  Y  *  I  *  T  M  L  I  I  F  L  F  F  N

21721 ATTTTTGTTATGGTTTTAATGAACCTTTGAATGTTGTGTCTCATTTAAACCATGACTGGT 21780
       I  F  V  M  V  L  M  N  L  *  M  L  C  L  I  *  T  M  T  G
        F  L  L  W  F  *  *  T  F  E  C  C  V  S  F  K  P  *  L  V
         F  C  Y  G  F  N  E  P  L  N  V  V  S  H  L  N  H  D  W  F

21781 TTTTATTTGGTGATAGTCGTTCTGATTGTAACCATATTAATAATTTAAAAATTAAAAATT 21840
       F  Y  L  V  I  V  V  L  I  V  T  I  L  I  I  *  K  L  K  I
        F  I  W  *  *  S  F  *  L  *  P  Y  *  *  F  K  N  *  K  L
         L  F  G  D  S  R  S  D  C  N  H  I  N  N  L  K  I  K  N  Y

21841 ATGGTTATTTGGATATTCACCCTAGTTTGTGTAATAATGGTAAAATTTCATCTAGTGCTG 21900
       M  V  I  W  I  F  T  L  V  C  V  I  M  V  K  F  H  L  V  L
        W  L  F  G  Y  S  P  *  F  V  *  *  W  *  N  F  I  *  C  W
         G  Y  L  D  I  H  P  S  L  C  N  N  G  K  I  S  S  S  A  G

21901 GTGATTCTATTTTTAAGAGTTATCATTTTACCCGGTTTTATAATTACACTGGCGAGGGTG 21960
       V  I  L  F  L  R  V  I  I  L  P  G  F  I  I  T  L  A  R  V
        *  F  Y  F  *  E  L  S  F  Y  P  V  L  *  L  H  W  R  G  *
         D  S  I  F  K  S  Y  H  F  T  R  F  Y  N  Y  T  G  E  G  D

21961 ATCAAATTATTTTTTATGAGGGTGTTAATTTCAATCCTCATCATAGGTTTAAGTGCTTCT 22020
       I  K  L  F  F  M  R  V  L  I  S  I  L  I  I  G  L  S  A  S
        S  N  Y  F  L  *  G  C  *  F  Q  S  S  S  *  V  *  V  L  L
         Q  I  I  F  Y  E  G  V  N  F  N  P  H  H  R  F  K  C  F  F

22021 TTAATGGTAGTAATGATGTATGGATTTTTAACAAGGTGAGGTTTTATCGTGCTTTATATT 22080
       L  M  V  V  M  M  Y  G  F  L  T  R  *  G  F  I  V  L  Y  I
        *  W  *  *  *  C  M  D  F  *  Q  G  E  V  L  S  C  F  I  F
         N  G  S  N  D  V  W  I  F  N  K  V  R  F  Y  R  A  L  Y  S

22081 CTAATATGGCTCTTTTTCGCTATCTTACCTTTGTTGATATTCTTTACAATTTTTCTTTTT 22140
       L  I  W  L  F  F  A  I  L  P  L  L  I  F  F  T  I  F  L  F
        *  Y  G  S  F  S  L  S  Y  L  C  *  Y  S  L  Q  F  F  F  F
         N  M  A  L  F  R  Y  L  T  F  V  D  I  L  Y  N  F  S  F  S
```

FIG. 9 CONT.

```
22141 CTATTAAGGCTAATATTTGTAATAGTAATATTTTATCACTTAATAATCCTATTTTTATTA 22200
      L  L  R  L  I  F  V  I  V  I  F  Y  H  L  I  I  L  F  L  L
       Y  *  G  *  Y  L  *  *  *  Y  F  I  T  *  *  S  Y  F  Y  *
        I  K  A  N  I  C  N  S  N  I  L  S  L  N  N  P  I  F  I  S

22201 GTACTAATTATTCTAAGGACGTTTATTTCACTTTATCAGGGTGTTCTTTGTATTTAGTAC 22260
      V  L  I  I  L  R  T  F  I  S  L  Y  Q  G  V  L  C  I  *  Y
       Y  *  L  F  *  G  R  L  F  H  F  I  R  V  F  F  V  F  S  T
        T  N  Y  S  K  D  V  Y  F  T  L  S  G  C  S  L  Y  L  V  P

22261 CTCTTTGTCTTTTTAAATCTAATTTTAGTCAGTACTATTATAATATGGATACTGGCTTTG 22320
      L  F  V  F  L  N  L  I  L  V  S  T  I  I  I  W  I  L  A  L
       S  L  S  F  *  I  *  F  *  S  V  L  L  *  Y  G  Y  W  L  C
        L  C  L  F  K  S  N  F  S  Q  Y  Y  Y  N  M  D  T  G  F  A

22321 CTTATGGTTATTCTAATTTTGTTTCTTCTGATTTAGATTGTACATATATTTCTCTTAAAC 22380
      L  M  V  I  L  I  L  F  L  L  I  *  I  V  H  I  F  L  L  N
       L  W  L  F  *  F  C  F  F  *  F  R  L  Y  I  Y  F  S  *  T
        Y  G  Y  S  N  F  V  S  S  D  L  D  C  T  Y  I  S  L  K  P

22381 CTGGTTCTTATAAAATTTTTTCTACTGGTTTTGTTTTATCCATACCTACTAAAGCTCTTT 22440
      L  V  L  I  K  F  F  L  L  V  L  F  Y  P  Y  L  L  K  L  F
       W  F  L  *  N  F  F  Y  W  F  C  F  I  H  T  Y  *  S  S  L
        G  S  Y  K  I  F  S  T  G  F  V  L  S  I  P  T  K  A  L  C

22441 GCTTTAATAAATCTAAACAATTTGTACCCGTGCAGGTTGTTGATTCTAGGTGGAACAATC 22500
      A  L  I  N  L  N  N  L  Y  P  C  R  L  L  I  L  G  G  T  I
       L  *  *  I  *  T  I  C  T  R  A  G  C  *  F  *  V  E  Q  S
        F  N  K  S  K  Q  F  V  P  V  Q  V  V  D  S  R  W  N  N  L

22501 TTCGTGCATCGGATACTTCATTATCCGATGCATGTCAGTTGCCTTATTGTTATTTTCGCA 22560
      F  V  H  R  I  L  H  Y  P  M  H  V  S  C  L  I  V  I  F  A
       S  C  I  G  Y  F  I  I  R  C  M  S  V  A  L  L  L  F  S  Q
        R  A  S  D  T  S  L  S  D  A  C  Q  L  P  Y  C  Y  F  R  N

22561 ATTCTTCTGGTAATTATGTTGGCAAATATGATATTAATCATGGTGATAATGGTTTTACTT 22620
      I  L  L  V  I  M  L  A  N  M  I  L  I  M  V  I  M  V  L  L
       F  F  W  *  L  C  W  Q  I  *  Y  *  S  W  *  *  W  F  Y  F
        S  S  G  N  Y  V  G  K  Y  D  I  N  H  G  D  N  G  F  T  S

22621 CTATTCTATCTGGTCTTTTATATAATGTCTCTTGTATTTCTTATTATGGCTCCTTTTTGT 22680
      L  F  Y  L  V  F  Y  I  M  S  L  V  F  L  I  M  A  P  F  C
       Y  S  I  W  S  F  I  *  C  L  L  Y  F  L  L  W  L  L  F  V
        I  L  S  G  L  L  Y  N  V  S  C  I  S  Y  Y  G  S  F  L  Y
```

FIG. 9 CONT.

```
22681 ATGACAATTTTACATCAATTTGGCCTCGTTTTTCTTTTGGTAATTGTCCTACATCTGCTT 22740
      M  T  I  L  H  Q  F  G  L  V  F  L  L  V  I  V  L  H  L  L
       *  Q  F  Y  I  N  L  A  S  F  F  F  W  *  L  S  Y  I  C  L
        D  N  F  T  S  I  W  P  R  F  S  F  G  N  C  P  T  S  A  Y

22741 ATATTAAATTAAATTGTTTCTATGATCCTTTGCCTATTATTTTACAAGGTATTTTATTAT 22800
      I  L  N  *  I  V  S  M  I  L  C  L  L  F  Y  K  V  F  Y  Y
       Y  *  I  K  L  F  L  *  S  F  A  Y  Y  F  T  R  Y  F  I  I
        I  K  L  N  C  F  Y  D  P  L  P  I  I  L  Q  G  I  L  L  F

22801 TTTTAGCTTTATTGTTTATTGTGTTTTTACTTTTTCTAGTTTACCATGGCTAATATTAAA 22860
      F  *  L  Y  C  L  L  C  F  Y  F  F  *  F  T  M  A  N  I  K
       F  S  F  I  V  Y  C  V  F  T  F  S  S  L  P  W  L  I  L  N
        L  A  L  L  F  I  V  F  L  L  F  L  V  Y  H  G  *  Y  *  I

22861 TCTAAACATGTTTTTAATTATTTTTATTTTGCCTACAACACTAGCTGTTATAGGTGATTT 22920
      S  K  H  V  F  N  Y  F  Y  F  A  Y  N  T  S  C  Y  R  *  F
       L  N  M  F  L  I  I  F  I  L  P  T  T  L  A  V  I  G  D  F
        *  T  C  F  *  L  F  L  F  C  L  Q  H  *  L  L  *  V  I  L

22921 TAATTGTACTAACTCTTTTATTAATGATTATAATAAAACCATTCCGCGTATAAGCGAGGA 22980
      *  L  Y  *  L  F  Y  *  *  L  *  *  N  H  S  A  Y  K  R  G
       N  C  T  N  S  F  I  N  D  Y  N  K  T  I  P  R  I  S  E  D
        I  V  L  T  L  L  L  M  I  I  I  K  P  F  R  V  *  A  R  M

22981 TGTTGTTGATGTATCTCTTGGTTTGGGCACATATTATGTTCTTAACCGTGTTTATTTAAA 23040
      C  C  *  C  I  S  W  F  G  H  I  L  C  S  *  P  C  L  F  K
       V  V  D  V  S  L  G  L  G  T  Y  Y  V  L  N  R  V  Y  L  N
        L  L  M  Y  L  L  V  W  A  H  I  M  F  L  T  V  F  I  *  I

23041 TACTACCTTGTTATTTACAGGTTATTTTCCTAAATCTGGTGCTAATTTTAGAGACTTGGC 23100
      Y  Y  L  V  I  Y  R  L  F  S  *  I  W  C  *  F  *  R  L  G
       T  T  L  L  F  T  G  Y  F  P  K  S  G  A  N  F  R  D  L  A
        L  P  C  Y  L  Q  V  I  F  L  N  L  V  L  I  L  E  T  W  L

23101 TTTAAAGGGTTCTAAATATTTGAGTACTCTCTGGTATAAACCACCTTTTCTGTCAGATTT 23160
      F  K  G  F  *  I  F  E  Y  S  L  V  *  T  T  F  S  V  R  F
       L  K  G  S  K  Y  L  S  T  L  W  Y  K  P  P  F  L  S  D  F
        *  R  V  L  N  I  *  V  L  S  G  I  N  H  L  F  C  Q  I  L

23161 TAATAATGGTATTTTTTCTAAGGTTAAGAATACTAAGTTATATGTTAATAATACTTTGTA 23220
      *  *  W  Y  F  F  *  G  *  E  Y  *  V  I  C  *  *  Y  F  V
       N  N  G  I  F  S  K  V  K  N  T  K  L  Y  V  N  N  T  L  Y
        I  M  V  F  F  L  R  L  R  I  L  S  Y  M  L  I  I  L  C  I
```

FIG. 9 CONT.

```
23221 TAGTGAATTTAGTACTATAGTTATAGGTAGTGTTTTTGTTAATACTTCTTATACTATTGT 23280
      *  *  I  *  Y  Y  S  Y  R  *  C  F  C  *  Y  F  L  Y  Y  C
       S  E  F  S  T  I  V  I  G  S  V  F  V  N  T  S  Y  T  I  V
        V  N  L  V  L  *  L  *  V  V  F  L  L  I  L  L  I  L  L  L

23281 TGTTCAACCTCACAATGGTATTTTGGAGATTACAGCTTGTCAGTATACTATGTGTGAATA 23340
      C  S  T  S  Q  W  Y  F  G  D  Y  S  L  S  V  Y  Y  V  *  I
       V  Q  P  H  N  G  I  L  E  I  T  A  C  Q  Y  T  M  C  E  Y
        F  N  L  T  M  V  F  W  R  L  Q  L  V  S  I  L  C  V  N  I

23341 TCCTCACACTGTTTGTAAGTCTAAGGGTAGTATTCGTAATGAATCTTGGCACATTGATTC 23400
      S  S  H  C  L  *  V  *  G  *  Y  S  *  *  I  L  A  H  *  F
       P  H  T  V  C  K  S  K  G  S  I  R  N  E  S  W  H  I  D  S
        L  T  L  F  V  S  L  R  V  V  F  V  M  N  L  G  T  L  I  L

23401 TTCGGAACCTTTATGCTTGTTTAAGAAAAATTTTACTTATAATGTTTCTGCAGATTGGCT 23460
      F  G  T  F  M  L  V  *  E  K  F  Y  L  *  C  F  C  R  L  A
       S  E  P  L  C  L  F  K  K  N  F  T  Y  N  V  S  A  D  W  L
        R  N  L  Y  A  C  L  R  K  I  L  L  I  M  F  L  Q  I  G  C

23461 GTATTTTCATTTTTATCAAGAACGTGGTGTTTTTTATGCATATTATGCAGATGTAGGTAT 23520
      V  F  S  F  L  S  R  T  W  C  F  L  C  I  L  C  R  C  R  Y
       Y  F  H  F  Y  Q  E  R  G  V  F  Y  A  Y  Y  A  D  V  G  M
        I  F  I  F  I  K  N  V  V  F  F  M  H  I  M  Q  M  *  V  C

23521 GCCTACCACTTTCTTATTTAGTTTATATTTAGGTACTATTTTATCTCATTATTATGTTAT 23580
      A  Y  H  F  L  I  *  F  I  F  R  Y  Y  F  I  S  L  L  C  Y
       P  T  T  F  L  F  S  L  Y  L  G  T  I  L  S  H  Y  Y  V  M
        L  P  L  S  Y  L  V  Y  I  *  V  L  F  Y  L  I  I  M  L  C

23581 GCCTTTGACTTGTAAGGCTATATCTTCAAATACTGACAATGAAACTTTAGAATATTGGGT 23640
      A  F  D  L  *  G  Y  I  F  K  Y  *  Q  *  N  F  R  I  L  G
       P  L  T  C  K  A  I  S  S  N  T  D  N  E  T  L  E  Y  W  V
        L  *  L  V  R  L  Y  L  Q  I  L  T  M  K  L  *  N  I  G  L

23641 TACACCGCTATCTAGACGTCAGTATCTTCTTAATTTTGATGAGCACGGTGTTATTACTAA 23700
      Y  T  A  I  *  T  S  V  S  S  *  F  *  *  A  R  C  Y  Y  *
       T  P  L  S  R  R  Q  Y  L  L  N  F  D  E  H  G  V  I  T  N
        H  R  Y  L  D  V  S  I  F  L  I  L  M  S  T  V  L  L  L  M

23701 TGCCGTTGATTGTTCAAGTAGTTTTCTTAGTGAGATTCAATGTAAAACTCAATCTTTTGC 23760
      C  R  *  L  F  K  *  F  S  *  *  D  S  M  *  N  S  I  F  C
       A  V  D  C  S  S  S  F  L  S  E  I  Q  C  K  T  Q  S  F  A
        P  L  I  V  Q  V  V  F  L  V  R  F  N  V  K  L  N  L  L  H
```

FIG. 9 CONT.

```
23761 ACCTAATACTGGTGTTTATGATTTGTCTGGTTTTACTGTAAAGCCTGTTGCAACTGTTTA 23820
      T  *  Y  W  C  L  *  F  V  W  F  Y  C  K  A  C  C  N  C  L
       P  N  T  G  V  Y  D  L  S  G  F  T  V  K  P  V  A  T  V  Y
        L  I  L  V  F  M  I  C  L  V  L  L  *  S  L  L  Q  L  F  I

23821 TCGTCGGATTCCTAATTTACCTGATTGTGACATTGACAACTGGCTTAATAATGTTAGTGT 23880
      S  S  D  S  *  F  T  *  L  *  H  *  Q  L  A  *  *  C  *  C
       R  R  I  P  N  L  P  D  C  D  I  D  N  W  L  N  N  V  S  V
        V  G  F  L  I  Y  L  I  V  T  L  T  T  G  L  I  M  L  V  Y

23881 ACCTTCACCTCTTAATTGGGAACGTAGAATTTTTTCTAATTGTAACTTCAATTTAAGCAC 23940
      T  F  T  S  *  L  G  T  *  N  F  F  *  L  *  L  Q  F  K  H
       P  S  P  L  N  W  E  R  R  I  F  S  N  C  N  F  N  L  S  T
        L  H  L  L  I  G  N  V  E  F  F  L  I  V  T  S  I  *  A  L

23941 TTTACTTCGTCTAGTTCATGTTGATTCTTTTTCTTGTAATAATCTTGATAAATCTAAAAT 24000
      F  T  S  S  S  C  *  F  F  F  L  *  *  S  *  *  I  *  N
       L  L  R  L  V  H  V  D  S  F  S  C  N  N  L  D  K  S  K  I
        Y  F  V  *  F  M  L  I  L  F  L  V  I  I  L  I  N  L  K  F

24001 TTTTGGTAGTTGCTTTAATAGTATTACTGTTGACAAGTTTGCTATACCTAATCGCAGACG 24060
      F  W  *  L  L  *  *  Y  Y  C  *  Q  V  C  Y  T  *  S  Q  T
       F  G  S  C  F  N  S  I  T  V  D  K  F  A  I  P  N  R  R  R
        L  V  V  A  L  I  V  L  L  L  T  S  L  L  Y  L  I  A  D  E

24061 AGATGATTTGCAATTGGGCAGTTCTGGCTTTTTGCAATCATCTAATTACAAAATAGATAT 24120
      R  *  F  A  I  G  Q  F  W  L  F  A  I  I  *  L  Q  N  R  Y
       D  D  L  Q  L  G  S  S  G  F  L  Q  S  S  N  Y  K  I  D  I
        M  I  C  N  W  A  V  L  A  F  C  N  H  L  I  T  K  *  I  F

24121 TTCTTCTAGTTCTTGTCAATTGTATTATAGTTTACCTTTAGTTAATGTTACTATTAATAA 24180
      F  F  *  F  L  S  I  V  L  *  F  T  F  S  *  C  Y  Y  *  *
       S  S  S  S  C  Q  L  Y  Y  S  L  P  L  V  N  V  T  I  N  N
        L  L  V  L  V  N  C  I  I  V  Y  L  *  L  M  L  L  L  I  T

24181 CTTTAATCCATCTTCTTGGAATAGGAGGTATGGTTTTGGTAGTTTTAATGTGTCTTCTTA 24240
      L  *  S  I  F  L  E  *  E  V  W  F  W  *  F  *  C  V  F  L
       F  N  P  S  S  W  N  R  R  Y  G  F  G  S  F  N  V  S  S  Y
        L  I  H  L  L  G  I  G  G  M  V  L  V  V  L  M  C  L  L  M

24241 TGACGTTGTTTATTCTGATCATTGTTTTTCTGTTAACAGCGACTTTTGCCCTTGTGCAGA 24300
      *  R  C  L  F  *  S  L  F  F  C  *  Q  R  L  L  P  L  C  R
       D  V  V  Y  S  D  H  C  F  S  V  N  S  D  F  C  P  C  A  D
        T  L  F  I  L  I  I  V  F  L  L  T  A  T  F  A  L  V  Q  I
```

FIG. 9 CONT.

```
24301 TCCGTCTGTTGTTAATTCTTGTGTTAAATCTAAGCCTCTTTCTGCCATTTGTCCTGCTGG 24360
      S  V  C  C  *  F  L  C  *  I  *  A  S  F  C  H  L  S  C  W
       P  S  V  V  N  S  C  V  K  S  K  P  L  S  A  I  C  P  A  G
        R  L  L  L  I  L  V  L  N  L  S  L  F  L  P  F  V  L  L  V

24361 TACTAAATATCGTCATTGCGACTTGGATACTACTCTTTATGTTAATAACTGGTGTAGATG 24420
      Y  *  I  S  S  L  R  L  G  Y  Y  S  L  C  *  *  L  V  *  M
       T  K  Y  R  H  C  D  L  D  T  T  L  Y  V  N  N  W  C  R  C
        L  N  I  V  I  A  T  W  I  L  L  F  M  L  I  T  G  V  D  V

24421 TTCTTGTCTACCTGACCCCATTTCTACTTATTCTCCTAACACATGTCCTCAAAAGAAGGT 24480
      F  L  S  T  *  P  H  F  Y  L  F  S  *  H  M  S  S  K  E  G
       S  C  L  P  D  P  I  S  T  Y  S  P  N  T  C  P  Q  K  K  V
        L  V  Y  L  T  P  F  L  L  I  L  L  T  H  V  L  K  R  R  S

24481 CGTTGTTGGTATAGGTGAACATTGTCCAGGTCTTGGTATTAATGAGGAAAAATGTGGTAC 24540
      R  C  W  Y  R  *  T  L  S  R  S  W  Y  *  *  G  K  M  W  Y
       V  V  G  I  G  E  H  C  P  G  L  G  I  N  E  E  K  C  G  T
        L  L  V  *  V  N  I  V  Q  V  L  V  L  M  R  K  N  V  V  H

24541 ACAATTAAATCATAGTTCCTGTTCTTGTAGTCCTGATGCCTTTTTGGGTTGGTCTTTTGA 24600
      T  I  K  S  *  F  L  F  L  *  S  *  C  L  F  G  L  V  F  *
       Q  L  N  H  S  S  C  S  C  S  P  D  A  F  L  G  W  S  F  D
        N  *  I  I  V  P  V  L  V  V  L  M  P  F  W  V  G  L  L  I

24601 TAGTTGTATTAGTAATAATCGTTGCAATATTTTTTCTAATTTTATTTTTAATGGAATTAA 24660
      *  L  Y  *  *  *  S  L  Q  Y  F  F  *  F  Y  F  *  W  N  *
       S  C  I  S  N  N  R  C  N  I  F  S  N  F  I  F  N  G  I  N
        V  V  L  V  I  I  V  A  I  F  F  L  I  L  F  L  M  E  L  I

24661 TAGTGGCACCACTTGTTCTAATGATTTGTTATATTCTAACACTGAAGTTTCTACTGGTGT 24720
      *  W  H  H  L  F  *  *  F  V  I  F  *  H  *  S  F  Y  W  C
       S  G  T  T  C  S  N  D  L  L  Y  S  N  T  E  V  S  T  G  V
        V  A  P  L  V  L  M  I  C  Y  I  L  T  L  K  F  L  L  V  F

24721 TTGTGTTAATTATGATCTTTATGGCATCACAGGCCAAGGTATTTTTAAAGAAGTTTCTGC 24780
      L  C  *  L  *  S  L  W  H  H  R  P  R  Y  F  *  R  S  F  C
       C  V  N  Y  D  L  Y  G  I  T  G  Q  G  I  F  K  E  V  S  A
        V  L  I  M  I  F  M  A  S  Q  A  K  V  F  L  K  K  F  L  R

24781 GGCTTATTATAATAATTGGCAGAATCTTTTGTATGATTCTAATGGTAATATTATTGGTTT 24840
      G  L  L  *  *  L  A  E  S  F  V  *  F  *  W  *  Y  Y  W  F
       A  Y  Y  N  N  W  Q  N  L  L  Y  D  S  N  G  N  I  I  G  F
        L  I  I  I  I  G  R  I  F  C  M  I  L  M  V  I  L  L  V  L
```

FIG. 9 CONT.

```
24841 TAAAGATTTTTTGACTAATAAAACTTACACTATACTTCCTTGTTATTCTGGTAGAGTGTC 24900
      * R F F D * * N L H Y T S L L F W * S V
       K D F L T N K T Y T I L P C Y S G R V S
        K I F * L I K L T L Y F L V I L V E C L

24901 TGCTGCATTTTATCAAAATTCTTCTTCACCAGCTTTGCTTTATCGTAATTTAAAGTGTAG 24960
      C C I L S K F F F T S F A L S * F K V *
       A A F Y Q N S S S P A L L Y R N L K C S
        L H F I K I L L H Q L C F I V I * S V V

24961 TTATGTTTTGAATAATATTTCTTTTATCTCACAACCATTTTATTTTGATAGTTATCTTGG 25020
      L C F E * Y F F Y L T T I L F * * L S W
       Y V L N N I S F I S Q P F Y F D S Y L G
        M F * I I F L L S H N H F I L I V I L V

25021 TTGTGTTTTGAATGCTGTTAATTTAACTAGCTATTCTGTATCCTCTTGTGATTTGCGTAT 25080
      L C F E C C * F N * L F C I L L * F A Y
       C V L N A V N L T S Y S V S S C D L R M
        V F * M L L I * L A I L Y P L V I C V W

25081 GGGTAGTGGGTTTTGTATTGATTATGCTTTACCCTCTTCTCGGCGTAAGCGTAGAGGTAT 25140
      G * W V L Y * L C F T L F S A * A * R Y
       G S G F C I D Y A L P S S R R K R R G I
        V V G F V L I M L Y P L L G V S V E V F

25141 TTCTTCTCCTTATCGCTTTGTAACTTTTGAACCCTTTAATGTTAGTTTTGTTAACGATAG 25200
      F F S L S L C N F * T L * C * F C * R *
       S S P Y R F V T F E P F N V S F V N D S
        L L L I A L * L L N P L M L V L L T I V

25201 TGTTGAAACTGTTGGTGGTTTATTTGAGATTCAGATTCCTACTAACTTTACCATAGCTGG 25260
      C * N C W W F I * D S D S Y * L Y H S W
       V E T V G G L F E I Q I P T N F T I A G
        L K L L V V Y L R F R F L L T L P * L V

25261 TCATGAAGAATTTATTCAGACTAGTTCTCCTAAAGTTACTATTGATTGTTCAGCTTTTGT 25320
      S * R I Y S D * F S * S Y Y * L F S F C
       H E E F I Q T S S P K V T I D C S A F V
        M K N L F R L V L L K L L L I V Q L L F

25321 TTGCTCTAATTATGCTGCTTGTCATGATTTATTGTCGGAATATGGCACTTTTTGCGATAA 25380
      L L * L C C L S * F I V G I W H F L R *
       C S N Y A A C H D L L S E Y G T F C D N
        A L I M L L V M I Y C R N M A L F A I I
```

FIG. 9 CONT.

```
25381 TATTAATAGTATTTTAAATGAAGTCAATGATTTACTTGATATTACTCAGTTGCAGGTTGC 25440
      Y  *  *  Y  F  K  *  S  Q  *  F  T  *  Y  Y  S  V  A  G  C
       I  N  S  I  L  N  E  V  N  D  L  L  D  I  T  Q  L  Q  V  A
        L  I  V  F  *  M  K  S  M  I  Y  L  I  L  L  S  C  R  L  L

25441 TAATGCTTTAATGCAAGGTGTTACACTTAGTTCTAATCTTAATACTAATCTACACTCTGA 25500
      *  C  F  N  A  R  C  Y  T  *  F  *  S  *  Y  *  S  T  L  *
       N  A  L  M  Q  G  V  T  L  S  S  N  L  N  T  N  L  H  S  D
        M  L  *  C  K  V  L  H  L  V  L  I  L  I  L  I  Y  T  L  M

25501 TGTTGATAATATAGATTTTAAATCTCTTCTAGGTTGTTTAGGTTCACAATGTGGTTCTTC 25560
      C  *  *  Y  R  F  *  I  S  S  R  L  F  R  F  T  M  W  F  F
       V  D  N  I  D  F  K  S  L  L  G  C  L  G  S  Q  C  G  S  S
        L  I  I  *  I  L  N  L  F  *  V  V  *  V  H  N  V  V  L  R

25561 GTCTAGATCTTTGTTAGAGGATTTATTATTCAACAAGGTCAAACTTTCAGATGTAGGTTT 25620
      V  *  I  F  V  R  G  F  I  I  Q  Q  G  Q  T  F  R  C  R  F
       S  R  S  L  L  E  D  L  L  F  N  K  V  K  L  S  D  V  G  F
        L  D  L  C  *  R  I  Y  Y  S  T  R  S  N  F  Q  M  *  V  L

25621 TGTTGAAGCTTATAATAATTGCACTGGTGGTAGTGAAATTAGAGATCTTCTCTGTGTGCA 25680
      C  *  S  L  *  *  L  H  W  W  *  *  N  *  R  S  S  L  C  A
       V  E  A  Y  N  N  C  T  G  G  S  E  I  R  D  L  L  C  V  Q
        L  K  L  I  I  I  A  L  V  V  V  K  L  E  I  F  S  V  C  N

25681 ATCTTTTAATGGTATTAAAGTATTACCTCCCATTTTATCTGAGACTCAAATTTCTGGCTA 25740
      I  F  *  W  Y  *  S  I  T  S  H  F  I  *  D  S  N  F  W  L
       S  F  N  G  I  K  V  L  P  P  I  L  S  E  T  Q  I  S  G  Y
        L  L  M  V  L  K  Y  Y  L  P  F  Y  L  R  L  K  F  L  A  I

25741 TACTACAGCTGCTACTGTGGCGGCTATGTTTCCGCCATGGTCTGCTGCTGCTGGTGTACC 25800
      Y  Y  S  C  Y  C  G  G  Y  V  S  A  M  V  C  C  C  W  C  T
       T  T  A  A  T  V  A  A  M  F  P  P  W  S  A  A  A  G  V  P
        L  Q  L  L  L  W  R  L  C  F  R  H  G  L  L  L  L  V  Y  H

25801 ATTTTCTCTTAATGTACAATATAGAATTAATGGTTTGGGTGTTACTATGGATGTTCTTAA 25860
      I  F  S  *  C  T  I  *  N  *  W  F  G  C  Y  Y  G  C  S  *
       F  S  L  N  V  Q  Y  R  I  N  G  L  G  V  T  M  D  V  L  N
        F  L  L  M  Y  N  I  E  L  M  V  W  V  L  L  W  M  F  L  I

25861 TAAGAATCAAAAGTTAATAGCTAATGCTTTTAATAAAGCTCTTCTTTCTATCCAGAATGG 25920
      *  E  S  K  V  N  S  *  C  F  *  *  S  S  S  F  Y  P  E  W
       K  N  Q  K  L  I  A  N  A  F  N  K  A  L  L  S  I  Q  N  G
        R  I  K  S  *  *  L  M  L  L  I  K  L  F  F  L  S  R  M  V
```

FIG. 9 CONT.

```
25921 TTTTACTGCTACTAACTCTGCTCTTGCTAAAATTCAAAGTGTCGTTAATGCTAATGCTCA 25980
      F  Y  C  Y  *  L  C  S  C  *  N  S  K  C  R  *  C  *  C  S
       F  T  A  T  N  S  A  L  A  K  I  Q  S  V  V  N  A  N  A  Q
        L  L  L  L  T  L  L  L  L  K  F  K  V  S  L  M  L  M  L  K

25981 AGCACTTAATAGTTTGTTACAACAATTATTTAATAAATTTGGTGCTATTAGTTCTTCTTT 26040
      S  T  *  *  F  V  T  T  I  I  *  *  I  W  C  Y  *  F  F  F
       A  L  N  S  L  L  Q  Q  L  F  N  K  F  G  A  I  S  S  S  L
        H  L  I  V  C  Y  N  N  Y  L  I  N  L  V  L  L  V  L  L  Y

26041 ACAAGAAATTTTGTCTCGCCTTGATAATTTAGAAGCTCAGGTTCAGATTGATAGGCTCAT 26100
      T  R  N  F  V  S  P  *  *  F  R  S  S  G  S  D  *  *  A  H
       Q  E  I  L  S  R  L  D  N  L  E  A  Q  V  Q  I  D  R  L  I
        K  K  F  C  L  A  L  I  I  *  K  L  R  F  R  L  I  G  S  L

26101 TAATGGTCGTTTGACTGCTTTAAATGCTTATGTTTCTCAACAGCTTAGTGATATTACACT 26160
      *  W  S  F  D  C  F  K  C  L  C  F  S  T  A  *  *  Y  Y  T
       N  G  R  L  T  A  L  N  A  Y  V  S  Q  Q  L  S  D  I  T  L
        M  V  V  *  L  L  *  M  L  M  F  L  N  S  L  V  I  L  H  L

26161 TATTAAGGCTGGAGCTTCTCGTGCTATTGAGAAGGTTAATGAGTGTGTTAAAAGTCAATC 26220
      Y  *  G  W  S  F  S  C  Y  *  E  G  *  *  V  C  *  K  S  I
       I  K  A  G  A  S  R  A  I  E  K  V  N  E  C  V  K  S  Q  S
        L  R  L  E  L  L  V  L  L  R  R  L  M  S  V  L  K  V  N  P

26221 CCCTCGTATAAATTTTTGTGGCAATGGTAACCACATTTTATCATTGGTTCAAAATGCTCC 26280
      P  S  Y  K  F  L  W  Q  W  *  P  H  F  I  I  G  S  K  C  S
       P  R  I  N  F  C  G  N  G  N  H  I  L  S  L  V  Q  N  A  P
        L  V  *  I  F  V  A  M  V  T  T  F  Y  H  W  F  K  M  L  L

26281 TTATGGTTTGCTTTTCATTCATTTTAGTTATAAACCTACTTCTTTTAAAACTGTCTTAGT 26340
      L  W  F  A  F  H  S  F  *  L  *  T  Y  F  F  *  N  C  L  S
       Y  G  L  L  F  I  H  F  S  Y  K  P  T  S  F  K  T  V  L  V
        M  V  C  F  S  F  I  L  V  I  N  L  L  L  L  K  L  S  *  *

26341 AAGTCCAGGTTTATGTTTATCCGGTGATAGAGGTATTGCACCTAAGCAAGGTTATTTTAT 26400
      K  S  R  F  M  F  I  R  *  *  R  Y  C  T  *  A  R  L  F  Y
       S  P  G  L  C  L  S  G  D  R  G  I  A  P  K  Q  G  Y  F  I
        V  Q  V  Y  V  Y  P  V  I  E  V  L  H  L  S  K  V  I  L  L

26401 TAAACAAAATGATTCCTGGATGTTTACTGGTAGTTCCTATTATTACCCAGAACCAATTTC 26460
      *  T  K  *  F  L  D  V  Y  W  *  F  L  L  L  P  R  T  N  F
       K  Q  N  D  S  W  M  F  T  G  S  S  Y  Y  Y  P  E  P  I  S
        N  K  M  I  P  G  C  L  L  V  V  P  I  I  T  Q  N  Q  F  Q
```

FIG. 9 CONT.

```
26461 AGATAAAAATGTTGTTTTCATGAATAGTTGCTCTGTTAATTTTACTAAAGCTCCATTTAT 26520
      R  *  K  C  C  F  H  E  *  L  L  C  *  F  Y  *  S  S  I  Y
       D  K  N  V  V  F  M  N  S  C  S  V  N  F  T  K  A  P  F  I
        I  K  M  L  F  S  *  I  V  A  L  L  I  L  L  K  L  H  L  F

26521 TTATCTTAATAATTCTATACCAAATTTGTCTGATTTTGAAGCCGAGTTTTCTCTTTGGTT 26580
      L  S  *  *  F  Y  T  K  F  V  *  F  *  S  R  V  F  S  L  V
       Y  L  N  N  S  I  P  N  L  S  D  F  E  A  E  F  S  L  W  F
        I  L  I  I  L  Y  Q  I  C  L  I  L  K  P  S  F  L  F  G  L

26581 TAAAAATCATACTTCTATAGCACCTAATTTAACCTTTAATTCTCATATTAATGCTACTTT 26640
      *  K  S  Y  F  Y  S  T  *  F  N  L  *  F  S  Y  *  C  Y  F
       K  N  H  T  S  I  A  P  N  L  T  F  N  S  H  I  N  A  T  F
        K  I  I  L  L  *  H  L  I  *  P  L  I  L  I  L  M  L  L  F

26641 TTTAGATCTGTATTATGAAATGAATGTTATTCAGGAATCTATTAAATCTTTGAACAGTAG 26700
      F  R  S  V  L  *  N  E  C  Y  S  G  I  Y  *  I  F  E  Q  *
       L  D  L  Y  Y  E  M  N  V  I  Q  E  S  I  K  S  L  N  S  S
        *  I  C  I  M  K  *  M  L  F  R  N  L  L  N  L  *  T  V  V

26701 TTTTATTAATCTTAAAGAAATAGGTACTTATGAAATGTATGTTAAATGGCCTTGGTACAT 26760
      F  Y  *  S  *  R  N  R  Y  L  *  N  V  C  *  M  A  L  V  H
       F  I  N  L  K  E  I  G  T  Y  E  M  Y  V  K  W  P  W  Y  I
        L  L  I  L  K  K  *  V  L  M  K  C  M  L  N  G  L  G  T  F

26761 TTGGTTGTTAATTGTCATTTTATTTATAATTTTTCTTATGATACTTTTCTTTATATGCTG 26820
      L  V  V  N  C  H  F  I  Y  N  F  S  Y  D  T  F  L  Y  M  L
       W  L  L  I  V  I  L  F  I  I  F  L  M  I  L  F  F  I  C  C
        G  C  *  L  S  F  Y  L  *  F  F  L  *  Y  F  S  L  Y  A  A

26821 CTGTACTGGTTGTGGTTCAGCATGTTTTAGTAAATGTCATAATTGTTGTGATGAGTATGG 26880
      L  Y  W  L  W  F  S  M  F  *  *  M  S  *  L  L  *  *  V  W
       C  T  G  C  G  S  A  C  F  S  K  C  H  N  C  C  D  E  Y  G
        V  L  V  V  V  Q  H  V  L  V  N  V  I  I  V  V  M  S  M  G

26881 GGGTCACAATGATTTTGTTATTAAAGCATCTCATGATGATTAGATTTTAAATCTAAACTT 26940
      G  S  Q  *  F  C  Y  *  S  I  S  *  *  L  D  F  K  S  K  L
       G  H  N  D  F  V  I  K  A  S  H  D  D  *  I  L  N  L  N  F
        V  T  M  I  L  L  L  K  H  L  M  M  I  R  F  *  I  *  T  L

26941 TATATATGGAAGTTTGGAGGCCTAGCTATAAATATTCTCTTATTACTAGAGAATTTGGTG 27000
      Y  I  W  K  F  G  G  L  A  I  N  I  L  L  L  L  E  N  L  V
       I  Y  G  S  L  E  A  *  L  *  I  F  S  Y  Y  *  R  I  W  C
        Y  M  E  V  W  R  P  S  Y  K  Y  S  L  I  T  R  E  F  G  V
```

FIG. 9 CONT.

```
27001 TCACAGATCTTGAGGATTTGTGTTTTAAATATAATTATTGCCAACCTTGTGTTGGTTATT 27060
      S  Q  I  L  R  I  C  V  L  N  I  I  I  A  N  L  V  L  V  I
       H  R  S  *  G  F  V  F  *  I  *  L  L  P  T  L  C  W  L  L
        T  D  L  E  D  L  C  F  K  Y  N  Y  C  Q  P  C  V  G  Y  C

27061 GTATTGTACCTTTAAACGTTTGGTGTCGTAAGTTTGGTAAATTTGCTTCTTATTTTGTTT 27120
      V  L  Y  L  *  T  F  G  V  V  S  L  V  N  L  L  L  I  L  F
       Y  C  T  F  K  R  L  V  S  *  V  W  *  I  C  F  L  F  C  F
        I  V  P  L  N  V  W  C  R  K  F  G  K  F  A  S  Y  F  V  L

27121 TACGTAGTCATGACACCTCTCATAAGAATAATTTTGGTGTTATAACTAGTTTTACTAGTT 27180
      Y  V  V  M  T  P  L  I  R  I  I  L  V  L  *  L  V  L  L  V
       T  *  S  *  H  L  S  *  E  *  F  W  C  Y  N  *  F  Y  *  L
        R  S  H  D  T  S  H  K  N  N  F  G  V  I  T  S  F  T  S  Y

27181 ATGGTAACACTGTTTCTGAGGCTGTTTCTAAATTAGTTGAATCAGCATCTGATTTTATCG 27240
      M  V  T  L  F  L  R  L  F  L  N  *  L  N  Q  H  L  I  L  S
       W  *  H  C  F  *  G  C  F  *  I  S  *  I  S  I  *  F  Y  R
        G  N  T  V  S  E  A  V  S  K  L  V  E  S  A  S  D  F  I  A

27241 CTTGGCGAGCTGAAGCACTTAATAAGTATGGTTGATGTATTTTTCACTGATACTGCTTGG 27300
      L  G  E  L  K  H  L  I  S  M  V  D  V  F  F  T  D  T  A  W
       L  A  S  *  S  T  *  *  V  W  L  M  Y  F  S  L  I  L  L  G
        W  R  A  E  A  L  N  K  Y  G  *  C  I  F  H  *  Y  C  L  V

27301 TATGTAGGTCAGATTTTCTTTTTAGTTTTATCTTGTGTCATTTTCTTAATTTTTGTTGTT 27360
      Y  V  G  Q  I  F  F  L  V  L  S  C  V  I  F  L  I  F  V  V
       M  *  V  R  F  S  F  *  F  Y  L  V  S  F  S  *  F  L  L  L
        C  R  S  D  F  L  F  S  F  I  L  C  H  F  L  N  F  C  C  C

27361 GCACTTTTAGCAACTATTAAACTTTGTATTCAAATTTGTGGTTTTTGTAATATTTTTATT 27420
      A  L  L  A  T  I  K  L  C  I  Q  I  C  G  F  C  N  I  F  I
       H  F  *  Q  L  L  N  F  V  F  K  F  V  V  F  V  I  F  L  L
        T  F  S  N  Y  *  T  L  Y  S  N  L  W  F  L  *  Y  F  Y  Y

27421 ATTTCACCTTCTGCCTATGTTTATAATAGAGGTAGACAGTTGTATAAGTCTTATAGTGAA 27480
      I  S  P  S  A  Y  V  Y  N  R  G  R  Q  L  Y  K  S  Y  S  E
       F  H  L  L  P  M  F  I  I  E  V  D  S  C  I  S  L  I  V  N
        F  T  F  C  L  C  L  *  *  R  *  T  V  V  *  V  L  *  *  T

27481 CATGTCATACCTTCTACTTTAGATGATTTAATTTAAATCTAAACATCATGAATGAATCAA 27540
      H  V  I  P  S  T  L  D  D  L  I  *  I  *  T  S  *  M  N  Q
       M  S  Y  L  L  L  *  M  I  *  F  K  S  K  H  H  E  *  I  N
        C  H  T  F  Y  F  R  *  F  N  L  N  L  N  I  M  N  E  S  I
```

FIG. 9 CONT.

```
27541 TTTTTCCTCATTGGAATTCTGATCAAGCTATTACATTCTTAAAAGAATGGAATTTCTCTT 27600
      F  F  L  I  G  I  L  I  K  L  L  H  S  *  K  N  G  I  S  L
       F  S  S  L  E  F  *  S  S  Y  Y  I  L  K  R  M  E  F  L  F
        F  P  H  W  N  S  D  Q  A  I  T  F  L  K  E  W  N  F  S  L

27601 TGGGTGTAATATTACTTCTCATTACTATCATACTGCAGTTTGGTTATACGAGTCGTAGTA 27660
      W  V  *  Y  Y  F  S  L  L  S  Y  C  S  L  V  I  R  V  V  V
       G  C  N  I  T  S  H  Y  Y  H  T  A  V  W  L  Y  E  S  *  Y
        G  V  I  L  L  L  I  T  I  I  L  Q  F  G  Y  T  S  R  S  M

27661 TGTTTGTTTATCTTATTAAGATGATTATTCTTTGGCTTATGTGGCCATTGACCATTATCT 27720
      C  L  F  I  L  L  R  *  L  F  F  G  L  C  G  H  *  P  L  S
       V  C  L  S  Y  *  D  D  Y  S  L  A  Y  V  A  I  D  H  Y  L
        F  V  Y  L  I  K  M  I  I  L  W  L  M  W  P  L  T  I  I  L

27721 TGACTATATTTAATTGCTTTTATGCTTTGAATAATATCTTTCTTGGGCTTTCTATACTGT 27780
      *  L  Y  L  I  A  F  M  L  *  I  I  S  F  L  G  F  L  Y  C
       D  Y  I  *  L  L  L  C  F  E  *  Y  L  S  W  A  F  Y  T  V
        T  I  F  N  C  F  Y  A  L  N  N  I  F  L  G  L  S  I  L  F

27781 TTACTATTATTTCTATTGTTATATGGATTTTATATTTTGTCAACAGTATTCGGCTTTTTA 27840
      L  L  L  F  L  L  L  Y  G  F  Y  I  L  S  T  V  F  G  F  L
       Y  Y  Y  F  Y  C  Y  M  D  F  I  F  C  Q  Q  Y  S  A  F  Y
        T  I  I  S  I  V  I  W  I  L  Y  F  V  N  S  I  R  L  F  I

27841 TCAGAACTGGCAGTTGGTGGAGTTTTAACCCAGAGACTAATAATCTTATGTGTATTGATA 27900
      S  E  L  A  V  G  G  V  L  T  Q  R  L  I  I  L  C  V  L  I
       Q  N  W  Q  L  V  E  F  *  P  R  D  *  *  S  Y  V  Y  *  Y
        R  T  G  S  W  W  S  F  N  P  E  T  N  N  L  M  C  I  D  M

27901 TGAAAGGTAAGATGTATGTTAGGCCAGTTATTGAGGACTATCATACATTAACGGCTACTG 27960
      *  K  V  R  C  M  L  G  Q  L  L  R  T  I  I  H  *  R  L  L
       E  R  *  D  V  C  *  A  S  Y  *  G  L  S  Y  I  N  G  Y  C
        K  G  K  M  Y  V  R  P  V  I  E  D  Y  H  T  L  T  A  T  V

27961 TTATCCGTGGTCATCTTTATATACAGGGTGTTAAACTTGGCACTGGTTACACGCTTGCCG 28020
      L  S  V  V  I  F  I  Y  R  V  L  N  L  A  L  V  T  R  L  P
       Y  P  W  S  S  L  Y  T  G  C  *  T  W  H  W  L  H  A  C  R
        I  R  G  H  L  Y  I  Q  G  V  K  L  G  T  G  Y  T  L  A  D

28021 ATTTGCCTGTTTATGTTACTGTAGCTAAGGTGCAAGTCCTCTGTACTTATAAACGTGCCT 28080
      I  C  L  F  M  L  L  *  L  R  C  K  S  S  V  L  I  N  V  P
       F  A  C  L  C  Y  C  S  *  G  A  S  P  L  Y  L  *  T  C  L
        L  P  V  Y  V  T  V  A  K  V  Q  V  L  C  T  Y  K  R  A  F
```

FIG. 9 CONT.

```
28081 TTTTAGATAAGTTAGATGTTAATAGTGGTTTTGCTGTTTTTGTTAAGTCTAAAGTTGGTA 28140
      F  *  I  S  *  M  L  I  V  V  L  L  F  L  L  S  L  K  L  V
       F  R  *  V  R  C  *  *  W  F  C  C  F  C  *  V  *  S  W  *
        L  D  K  L  D  V  N  S  G  F  A  V  F  V  K  S  K  V  G  N

28141 ACTATCGTTTACCTTCTAGTAAATCTAGTGGTATGGATACTGCCTTGTTGAGAGCTTAAA 28200
      T  I  V  Y  L  L  V  N  L  V  V  W  I  L  P  C  *  E  L  K
       L  S  F  T  F  *  *  I  *  W  Y  G  Y  C  L  V  E  S  L  N
        Y  R  L  P  S  S  K  S  S  G  M  D  T  A  L  L  R  A  *  I

28201 TCTAAACTATTAGGATGTCTTATACTCCCGGTCATCATGCTGGAAGTAGAAGCTCCTCTG 28260
      S  K  L  L  G  C  L  I  L  P  V  I  M  L  E  V  E  A  P  L
       L  N  Y  *  D  V  L  Y  S  R  S  S  C  W  K  *  K  L  L  W
        *  T  I  R  M  S  Y  T  P  G  H  H  A  G  S  R  S  S  S  G

28261 GAAATCGTTCAGGAATCCTCAAGAAAACTTCTTGGGTTGACCAATCTGAGCGAAGCCATC 28320
      E  I  V  Q  E  S  S  R  K  L  L  G  L  T  N  L  S  E  A  I
       K  S  F  R  N  P  Q  E  N  F  L  G  *  P  I  *  A  K  P  S
        N  R  S  G  I  L  K  K  T  S  W  V  D  Q  S  E  R  S  H  Q

28321 AAACCTATAATAGAGGCAGAAAACCCCAACCCAAATTCACTGTGTCTACTCAACCACAAG 28380
      K  P  I  I  E  A  E  N  P  N  P  N  S  L  C  L  L  N  H  K
       N  L  *  *  R  Q  K  T  P  T  Q  I  H  C  V  Y  S  T  T  R
        T  Y  N  R  G  R  K  P  Q  P  K  F  T  V  S  T  Q  P  Q  G

28381 GAAACCCTATCCCACATTATTCCTGGTTCTCTGGGATTACCCAATTTCAAAAAGGTAGAG 28440
      E  T  L  S  H  I  I  P  G  S  L  G  L  P  N  F  K  K  V  E
       K  P  Y  P  T  L  F  L  V  L  W  D  Y  P  I  S  K  R  *  R
        N  P  I  P  H  Y  S  W  F  S  G  I  T  Q  F  Q  K  G  R  D

28441 ACTTTAAATTTCCAGATGGTCAAGGAGTACCCATTGCTTACGGGATACCCCCTTCTGAAG 28500
      T  L  N  F  Q  M  V  K  E  Y  P  L  L  T  G  Y  P  L  L  K
       L  *  I  S  R  W  S  R  S  T  H  C  L  R  D  T  P  F  *  S
        F  K  F  P  D  G  Q  G  V  P  I  A  Y  G  I  P  P  S  E  A

28501 CAAAAGGATATTGGTATAAACACAACCGGCGTTCTTTTAAAACAGCTGATGGTCAACAAA 28560
      Q  K  D  I  G  I  N  T  T  G  V  L  L  K  Q  L  M  V  N  K
       K  R  I  L  V  *  T  Q  P  A  F  F  *  N  S  *  W  S  T  K
        K  G  Y  W  Y  K  H  N  R  R  S  F  K  T  A  D  G  Q  Q  K

28561 AGCAGTTGTTACCAAGATGGTATTTCTACTATCTCGGTACCGGTCCATATGCCAGTTCAT 28620
      S  S  C  Y  Q  D  G  I  S  T  I  S  V  P  V  H  M  P  V  H
       A  V  V  T  K  M  V  F  L  L  S  R  Y  R  S  I  C  Q  F  I
        Q  L  L  P  R  W  Y  F  Y  Y  L  G  T  G  P  Y  A  S  S  S
```

FIG. 9 CONT.

```
28621 CCTATGGTGATGCCCACGAAGGTATCTTCTGGGTCGCTAGTCACCAAGCTGACACTTCTA 28680
      P  M  V  M  P  T  K  V  S  S  G  S  L  V  T  K  L  T  L  L
       L  W  *  C  P  R  R  Y  L  L  G  R  *  S  P  S  *  H  F  Y
        Y  G  D  A  H  E  G  I  F  W  V  A  S  H  Q  A  D  T  S  I

28681 TTCCCTCCGATGTTTCGGCAAGGGATCCTACTATTCAAGAAGCTATCCCTACTAGGTTTT 28740
      F  P  P  M  F  R  Q  G  I  L  L  F  K  K  L  S  L  L  G  F
       S  L  R  C  F  G  K  G  S  Y  Y  S  R  S  Y  P  Y  *  V  F
        P  S  D  V  S  A  R  D  P  T  I  Q  E  A  I  P  T  R  F  S

28741 CGCCTGGTACGATTTTGCCTCAAGGCTATTATGTTGAAGGCTCAGGAAGGTCTGCTTCTA 28800
      R  L  V  R  F  C  L  K  A  I  M  L  K  A  Q  E  G  L  L  L
       A  W  Y  D  F  A  S  R  L  L  C  *  R  L  R  K  V  C  F  *
        P  G  T  I  L  P  Q  G  Y  Y  V  E  G  S  G  R  S  A  S  N

28801 ATAGCCGGCCAGGTTCACGTTCTCAATCACGTGGACCCAATAATCGTTCATTAAGTAGAA 28860
      I  A  G  Q  V  H  V  L  N  H  V  D  P  I  I  V  H  *  V  E
       *  P  A  R  F  T  F  S  I  T  W  T  Q  *  S  F  I  K  *  K
        S  R  P  G  S  R  S  Q  S  R  G  P  N  N  R  S  L  S  R  S

28861 GTAATTCTAATTTTAGACATTCTGATTCTATAGTGAAACCTGATATGGCTGATGAGATTG 28920
      V  I  L  I  L  D  I  L  I  L  *  *  N  L  I  W  L  M  R  L
       *  F  *  F  *  T  F  *  F  Y  S  E  T  *  Y  G  *  *  D  C
        N  S  N  F  R  H  S  D  S  I  V  K  P  D  M  A  D  E  I  A

28921 CTAGTCTTGTCTTGGCCAAGCTTGGTAAAGATTCTAAACCTCAGCAAGTTACCAAGCAAA 28980
      L  V  L  S  W  P  S  L  V  K  I  L  N  L  S  K  L  P  S  K
       *  S  C  L  G  Q  A  W  *  R  F  *  T  S  A  S  Y  Q  A  K
        S  L  V  L  A  K  L  G  K  D  S  K  P  Q  Q  V  T  K  Q  N

28981 ATGCTAAGGAAATTAGGCATAAAATTTTAATGAAACCTCGCCAAAAGCGAACTCCTAATA 29040
      M  L  R  K  L  G  I  K  F  *  *  N  L  A  K  S  E  L  L  I
       C  *  G  N  *  A  *  N  F  N  E  T  S  P  K  A  N  S  *  *
        A  K  E  I  R  H  K  I  L  M  K  P  R  Q  K  R  T  P  N  K

29041 AATTTTGTAATGTTCAACAGTGTTTTGGTAAAAGAGGACCGCTCCAAAACTTTGGTAATT 29100
      N  F  V  M  F  N  S  V  L  V  K  E  D  R  S  K  T  L  V  I
       I  L  *  C  S  T  V  F  W  *  K  R  T  A  P  K  L  W  *  F
        F  C  N  V  Q  Q  C  F  G  K  R  G  P  L  Q  N  F  G  N  S

29101 CTGAAATGTTAAAGCTTGGTACTAATGATCCTCAATTTCCTATTCTTGCTGAATTAGCCC 29160
      L  K  C  *  S  L  V  L  M  I  L  N  F  L  F  L  L  N  *  P
       *  N  V  K  A  W  Y  *  *  S  S  I  S  Y  S  C  *  I  S  P
        E  M  L  K  L  G  T  N  D  P  Q  F  P  I  L  A  E  L  A  P
```

FIG. 9 CONT.

```
29161 CTACACCAGGTGCTTTTTTCTTTGGCTCTAAATTAGAGTTGTTTAAAAGAGACTCTGATG 29220
      L  H  Q  V  L  F  S  L  A  L  N  *  S  C  L  K  E  T  L  M
       Y  T  R  C  F  F  L  W  L  *  I  R  V  V  *  K  R  L  *  C
        T  P  G  A  F  F  F  G  S  K  L  E  L  F  K  R  D  S  D  A

29221 CTGATTCACCTTCTAAAGACACTTTTGAACTTCGTTATTCTGGTTCTATTAGGTTTGATa 29280
      L  I  H  L  L  K  T  L  L  N  F  V  I  L  V  L  L  G  L  I
       *  F  T  F  *  R  H  F  *  T  S  L  F  W  F  Y  *  V  *  *
        D  S  P  S  K  D  T  F  E  L  R  Y  S  G  S  I  R  F  D  S

29281 GTACTTTACCTGGTTTTGAGACAATTATGAAAGTTCTTAAAGAGAATTTAGATGCTTATG 29340
      V  L  Y  L  V  L  R  Q  L  *  K  F  L  K  R  I  *  M  L  M
       Y  F  T  W  F  *  D  N  Y  E  S  S  *  R  E  F  R  C  L  C
        T  L  P  G  F  E  T  I  M  K  V  L  K  E  N  L  D  A  Y  V

29341 TTAATTCTAATCAGAACACTGTTTCTGGTTCGCTGAGTCCTAAACCTCAGCGTAAAAGAG 29400
      L  I  L  I  R  T  L  F  L  V  R  *  V  L  N  L  S  V  K  E
       *  F  *  S  E  H  C  F  W  F  A  E  S  *  T  S  A  *  K  R
        N  S  N  Q  N  T  V  S  G  S  L  S  P  K  P  Q  R  K  R  G

29401 GTGTTAAACAATCACCTGAATCGTTTGACTCTCTTAATTTAAGTGCTGATACTCAGCACA 29460
      V  L  N  N  H  L  N  R  L  T  L  L  I  *  V  L  I  L  S  T
       C  *  T  I  T  *  I  V  *  L  S  *  F  K  C  *  Y  S  A  H
        V  K  Q  S  P  E  S  F  D  S  L  N  L  S  A  D  T  Q  H  I

29461 TTTCAAATGATTTTACTCCTGAGGATCATAGTTTACTTGCTACTCTTGATGATCCTTATG 29520
      F  Q  M  I  L  L  L  R  I  I  V  Y  L  L  L  L  M  I  L  M
       F  K  *  F  Y  S  *  G  S  *  F  T  C  Y  S  *  *  S  L  C
        S  N  D  F  T  P  E  D  H  S  L  L  A  T  L  D  D  P  Y  V

29521 TAGAAGACTCTGTTGCTTAATGAGAATGAATCCTAATTCGACACTAGGTGGTAACCCCTC 29580
      *  K  T  L  L  L  N  E  N  E  S  *  F  D  T  R  W  *  P  L
       R  R  L  C  C  L  M  R  M  N  P  N  S  T  L  G  G  N  P  S
        E  D  S  V  A  *  *  E  *  I  L  I  R  H  *  V  V  T  P  R

29581 GCTATTAGTCGGAATAGGACACTCTCTATCAGAATGAATTCTTGCTGTTACAACAGATAG 29640
      A  I  S  R  N  R  T  L  S  I  R  M  N  S  C  C  Y  N  R  *
       L  L  V  G  I  G  H  S  L  S  E  *  I  L  A  V  T  T  D  R
        Y  *  S  E  *  D  T  L  Y  Q  N  E  F  L  L  L  Q  Q  I  E

29641 AGTAGGTTGTTGCAGACTATATATTAATTAGTAGAAACTTTATATTTAAATATTTGATTG 29700
      S  R  L  L  Q  T  I  Y  *  L  V  E  T  L  Y  L  N  I  *  L
       V  G  C  C  R  L  Y  I  N  *  *  K  L  Y  I  *  I  F  D  C
        *  V  V  A  D  Y  I  L  I  S  R  N  F  I  F  K  Y  L  I  V
```

FIG. 9 CONT.

```
29701 TTAGAGTAGTTATAAGGTTTAGCTGTAGTATAAACGCCTCCGGGAAGAGCTAGCAATTAT 29760
      L  E  *  L  *  G  L  A  V  V  *  T  P  P  G  R  A  S  N  Y
       *  S  S  Y  K  V  *  L  *  Y  K  R  L  R  E  E  L  A  I  I
        R  V  V  I  R  F  S  C  S  I  N  A  S  G  K  S  *  Q  L  *

29761 AGTATTTAATATATATATTAGTATATGATTGAAATTAATTATAGCCTTTTGGAGGAATTA 29820
      S  I  *  Y  I  Y  *  Y  M  I  E  I  N  Y  S  L  L  E  E  L
       V  F  N  I  Y  I  S  I  *  L  K  L  I  I  A  F  W  R  N  Y
        Y  L  I  Y  I  L  V  Y  D  *  N  *  L  *  P  F  G  G  I  T

29821 CAAAAAAAAAAAAAAA                                             29836
      Q  K  K  K  K  X
       K  K  K  K  K
        K  K  K  K
```

FIG. 9 CONT.

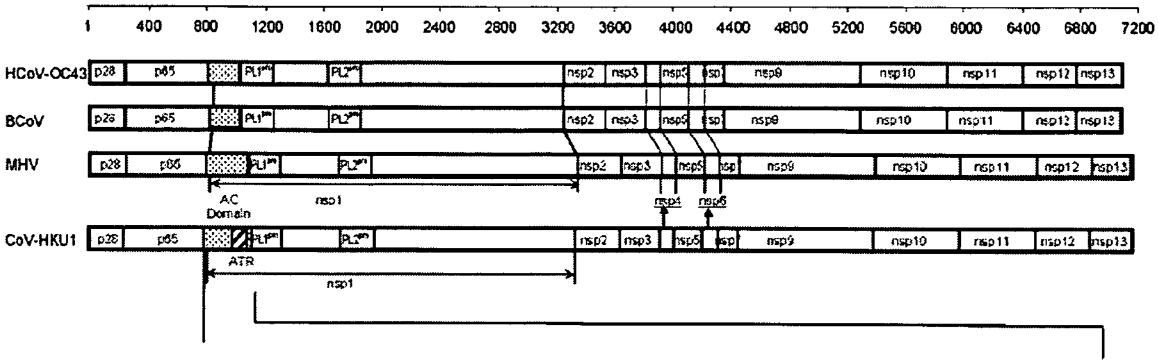

```
                                                             |<---- AC Domain
MHV                        VGEIEPAVFEDDVVDVVKAPLTYQGCCKPPTSFEKICIVDKLYMAKCGDQFYPVVVDNDT 819
BCoV                       KGSGSDFSLADSVVEVVTTSLTPCGYSEPPKVADKICIVDNVYMAKAGDKYYPVVVDG-H 838
HCoV-OC43                  KGSGSDFSLADSVVEVVTTSLTPCGYSEPPKVADKICIVDNVYMAKAGDKYYPVVVDD-H 838
CoV-HKU1(1st patient)      EGVAESVIVEDDVIENVKSSLSSYEYCQPPKSVEKICIIDNMYMGKCGDKFFPIVMNDKN 796
CoV-HKU1(2nd patient)      EGVAESVIVEDDVIENVKSSLSSYEYCQPPKSVEKICIIDNMYMGKCGDKFFPIVMNDKN 796
                           *  .    . *.*:: *.:.*:      .:**.   :****:*::**.*.**:::*:*::.

MHV                        VGVLDQCWRFPCAGKKVEFNDKPKVRKIPST-EKIKITFALDATFDSVLSKACSEFEVDK 878
BCoV                       VGLLDQAWRVPCAGRRVTFKEQPTVNEIASTPKTIKVFYELDKDFNTILNTACGVFEVDD 898
HCoV-OC43                  VGLLDQAWRVPCAGRRVTFKEQPTVKEIISMPKIIKVFYELDNDFNTILNTACGVFEVDD 898
CoV-HKU1(1st patient)      ICLLDQAWRFPCAGRKVNFNEKPVVMEIPSL-MTVKVMFDLDSTFDDILGKVCSEFEVEK 855
CoV-HKU1(2nd patient)      ICLLDQAWRFPCAGRKVNFNEKPVVMEIPSL-MTVKVMFDLDSTFDDILGKVCSEFEVEK 855
                           : :***.**.****::* *:::* * :* *     :*: : **  *: :*...*. ***:.

MHV                        DVTLDELLDVVLDAVESTLSPCKEHDVIGTKVCALLDRLAGDYVYLFDEGGDEVIAPRMY 938
BCoV                       TVDMEEFYAVVIDAIEEKLSPCKELEGVGAKVSAFLQKLEDNSLFLFDEAGEEVLASKLY 958
HCoV-OC43                  TVDMEEFYAVVIDAIEEKLSPCKELEGVGAKVSAFLQKLEDNPLFLFDEAGEEVLAPKLY 958
CoV-HKU1(1st patient)      GVTVDDFVAVVCDAIENALNSCKEHPVVGYQVRAFLNKLNENVVYLFDEAGDEAMASRMY 915
CoV-HKU1(2nd patient)      GVTVDDFVAVVCDAIENALNSCKDHPVVGYQVRAFLNKLNENVVYLFDEAGDEAMASRMY 915
                            * ::::  ** **:*. *..**:   :* :* *:*::*  : ::****.*:*.:*.::*

MHV                        CSFSAPDDEDCVAADVVDADEN-------QDD------DAEDSAVLVADTQEEDGVAKG- 984
BCoV                       CAFTAPEDDDFLEESGVE------------------------EDDVEGEETDLTVTSAG- 993
HCoV-OC43                  CAFTAPEDDDFLEESDVE------------------------EDDVEGEETDLTVTSAG- 993
CoV-HKU1(1st patient)      CTFAIEDVEDVISSEAVEDTIDGVVEDTINDDEDVVTGDNDDEDVVTGDNDDEDVVTGDN 975
CoV-HKU1(2nd patient)      CTFAIEDVEDVISSEAVEDTIDGVVEDTINDDEDVVTGDNDDEDVVTGDNDDEDVVTGDN 975
                           *:*:  : :* :  . *:                         .  : .:  :   .: .

MHV                        ------QVEADSEICVAHTGSQEELAEPDAVGSQTPIASAEETEVGEASDREGIAEAKAT 1038
BCoV                       ------------EPCVASEQEESSEILEDTLDDGPCVETSD-------SQVEEDVEMSDF 1034
HCoV-OC43                  ------------QPCVASEQEESSEVLEDTLDDGPSVETSD-------SQVEEDVEMSDF 1034
CoV-HKU1(1st patient)      DDEDVVTGDNDDEDVVTGDNDDEDVVTGDNDDEDVVTGDNDDEDVVTGDNDDEDVVTGDN 1035
CoV-HKU1(2nd patient)      DDEDVVTGDNDDEDVVTGDNDDEDVVTGDNDDEDVVTGDNDDEDVVTGDNDDEDVVTGDN 1035
                                  :  *:   .:..    *  ..       :        .: :  .

MHV                        VCADAVDACPDQVEAFSIEKVEDSILDELQTELNAPADK--------------------- 1077
BCoV                       ADLESVIQDYEN------------------------------------------------ 1046
HCoV-OC43                  VDLESVIQDYEN------------------------------------------------ 1046
CoV-HKU1(1st patient)      DDEDVVTGDNDDEDVVTGDNDDEDVVTGDNDDEDVVTGDNDDEDVVTGDNNDEEIVTGDN 1095
CoV-HKU1(2nd patient)      DDEDVVTGDNDDEDVVTGDNDDE------------------------------EIVTGDN 1065
                              :  *     ::

                                                 AC Domain  ---->|<---- PL1pro
MHV                        ---------------------TYEDVLAFDAVCSEALSAFYAVPSDETHF-KVCGFYSPA 1115
BCoV                       --------------------------------------VCFEFYTTEPEFVKVLDLYVPK 1068
HCoV-OC43                  --------------------------------------VCFEFYTTEPEFVKVLGLYVPK 1068
CoV-HKU1(1st patient)      DDQIVVTGDDVDDIESIYDFDTYKALLVFNDVYNDALFVSYGSSVETETYFKVNGLWSPT 1155
CoV-HKU1(2nd patient)      DDQIVVTGDDVDDIESIYDFDTYKALLVFNDVYNDALFVSYGSSVETETYFKVNGLWSPT 1125
                                                                  . :     .   ..**  .::  *
```

FIG. 10

Fig. 11. Multiple alignment of the replicase genes of CoV-HKU1 from patients 1, 2, 4, 5, 6, 7, 8, 9 and 10.

```
Patient 7     TCTAAAGATTTAAATTTTTTAAACCGGGTTCGGGGTACTAGTGTGAATGCCCGGCTAGTA 60
Patient 9     TCTAAAGATTTAAATTTTTTAAACCGGGTTCGGGGTACTAGTGTGAATGCCCGGCTAGTA 60
Patient 10    TCTAAAGATTTAAATTTTTTAAACCGGGTTCGGGGTACTAGTGTGAATGCCCGGCTAGTA 60
Patient 6     TCTAAAGATTTAAATTTTTTAAACCGGGTTCGGGGTACTAGTGTGAATGCCCGGCTAGTA 60
Patient 4     TCTAAAGATTTAAATTTTTTAAACCGGGTTCGGGGTACTAGTGTGAATGCCCGGCTAGTA 60
Patient 8     TCTAAAGATTTAAATTTTTTAAACCGGGTTAGGGGTACTAGTGTGAATGCCCGGCTAGTA 60
Patient 2     TCTAAAGATTTAAATTTTTTAAACCGGGTTCGGGGTACTAGTGTGAATGCCCGGCTAGTA 60
Patient 5     TCTAAAGATTTAAATTTTTTAAACCGGGTTCGGGGTACTAGTGTGAATGCCCGGCTAGTA 60
Patient 1     TCTAAAGATTTAAATTTTTTAAACCGGGTTCGGGGTACTAGTGTGAATGCCCGTCTAGTA 60
              ****************************** ********************** ******

Patient 7     CCCTGTGCTAGTGGTTTATCTACTGATGTTCAATTAAGGGCATTTGACATTTGTAATACC 120
Patient 9     CCCTGTGCTAGTGGTTTATCTACTGATGTTCAATTAAGGGCATTTGACATTTGTAATACC 120
Patient 10    CCCTGTGCTAGTGGTTTATCTACTGATGTTCAATTAAGGGCATTTGACATTTGTAATACC 120
Patient 6     CCCTGTGCTAGTGGTTTATCTACTGATGTTCAATTAAGGGCATTTGACATTTGTAATACC 120
Patient 4     CCCTGTGCTAGTGGTTTATCTACTGATGTTCAATTAAGGGCATTTGACATTTGTAATACC 120
Patient 8     CCCTGTGCTAGTGGTTTATCTACTGATGTTCAATTAAGGGCATTTGACATTTGTAATACC 120
Patient 2     CCCTGTGCTAGTGGTTTATCTACTGATGTTCAATTAAGGGCATTTGACATTTGTAATACC 120
Patient 5     CCCTGTGCTAGTGGTTTATCTACTGATGTTCAATTAAGGGCATTTGACATTTGTAATACC 120
Patient 1     CCCTGTGCTAGTGGTTTATCTACTGATGTTCAATTAAGGGCATTTGATATTTGTAATACT 120
              *********************************************** ***********

Patient 7     AATAGAGCTGGTATAGGTTTATATTATAAAGTGAATTGTTGCCGTTTTCAGCGTATAGAT 180
Patient 9     AATAGAGCTGGTATAGGTTTATATTATAAAGTGAATTGTTGCCGTTTTCAGCGTATAGAT 180
Patient 10    AATAGAGCTGGTATAGGTTTATATTATAAAGTGAATTGTTGCCGTTTTCAGCGTATAGAT 180
Patient 6     AATAGAGCTGGTATAGGTTTATATTATAAAGTGAATTGTTGCCGTTTTCAGCGTATAGAT 180
Patient 4     AATAGAGCTGGTATAGGTTTATATTATAAAGTGAATTGTTGCCGTTTTCAGCGTATAGAT 180
Patient 8     AATAGAGCTGGTATAGGTTTATATTATAAAGTGAATTGTTGCCGTTTTCAGCGTATAGAT 180
Patient 2     AATAGAGCTGGTATAGGTTTATATTATAAAGTGAATTGTTGCCGTTTTCAGCGTATAGAT 180
Patient 5     AATAGAGCTGGTATAGGTTTATATTATAAAGTGAATTGTTGCCGTTTTCAGCGTATAGAT 180
Patient 1     AATAGAGCTGGTATAGGTTTATATTATAAAGTGAATTGTTGCCGTTTTCAGCGTATAGAT 180
              ************************************************************

Patient 7     GACGACGGTAATAAATTGGATAAGTTCTTTGTTGTCAAAAGAACTAATTTAGAAGTTTAT 240
Patient 9     GACGACGGTAATAAATTGGATAAGTTCTTTGTTGTCAAAAGAACTAATTTAGAAGTTTAT 240
Patient 10    GACGACGGTAATAAATTGGATAAGTTCTTTGTTGTCAAAAGAACTAATTTAGAAGTTTAT 240
Patient 6     GACGACGGTAATAAATTGGATAAGTTCTTTGTTGTCAAAAGAACTAATTTAGAAGTTTAT 240
Patient 4     GACGACGGTAATAAATTGGATAAGTTCTTTGTTGTCAAAAGAACTAATTTAGAAGTTTAT 240
Patient 8     GACGACGGTAATAAATTGGATAAGTTCTTTGTTGTCAAAAGAACTAATTTAGAAGTTTAT 240
Patient 2     GACGACGGTAATAAATTGGATAAGTTCTTTGTTGTCAAAAGAACTAATTTAGAAGTTTAT 240
Patient 5     GACGACGGTAATAAATTGGATAAGTTCTTTGTTGTCAAAAGAACTAATTTAGAAGTTTAT 240
Patient 1     GACGACGGTAATAAATTGGATAAGTTCTTTGTTGTTAAAAGAACTAATCTAGAAGTTTAT 240
              *********************************** ************ ***********

Patient 7     AATAAAGAGAAAACTTATTATGAGTTGACTAAAAGTTGTGGTGTTGTGGCTGAACATGAT 300
Patient 9     AATAAAGAGAAAACTTATTATGAGTTGACTAAAAGTTGTGGTGTTGTGGCTGAACATGAT 300
Patient 10    AATAAAGAGAAAACTTATTATGAGTTGACTAAAAGTTGTGGTGTTGTGGCTGAACATGAT 300
Patient 6     AATAAAGAGAAAACTTATTATGAGTTGACTAAAAGTTGTGGTGTTGTGGCTGAACATGAT 300
Patient 4     AATAAAGAGAAAACTTATTATGAGTTGACTAAAAGTTGTGGTGTTGTGGCTGAACATGAT 300
Patient 8     AATAAAGAGAAAACTTATTATGAGTTGACTAAAAGTTGTGGTGTTGTGGCTGAACATGAT 300
Patient 2     AATAAAGAGAAAACTTATTATGAGTTGACTAAAAGTTGTGGTGTTGTGGCTGAACATGAT 300
Patient 5     AATAAAGAGAAAACTTATTATGAGTTGACTAAAAGTTGTGGTGTTGTGGCTGAACATGAT 300
Patient 1     AATAAAGAGAAAACTTATTATGAGTTGACTAAAAGTTGTGGTGTTGTGGCTGAACATGAT 300
              ************************************************************

Patient 7     TTCTTTATATTTGATATTGATGGTAGTCGCGTGCCACATATAGTTCGTAGGAATCTTTCA 360
Patient 9     TTCTTTACATTTGATATTGATGGTAGTCGCGTGCCACATATAGTTCGTAGGAATCTTTCA 360
Patient 10    TTCTTTACATTTGATATTGATGGTAGTCGCGTGCCACATATAGTTCGTAGGAATCTTTCA 360
Patient 6     TTCTTTACATTTGATATTGATGGTAGTCGCGTGCCACATATAGTTCGTAGGAATCTTTCA 360
Patient 4     TTCTTTACATTTGATATTGATGGTAGTCGCGTGCCACATATAGTTCGTAGGAATCTTTCA 360
Patient 8     TTCTTTACATTTGATATTGATGGTAGTCGCGTGCCACATATAGTTCGTAGGAATCTTTCA 360
Patient 2     TTCTTTACATTTGATATTGATGGTAGTCGCGTGCCACATATAGTTCGTAGGAATCTTTCA 360
Patient 5     TTCTTTACATTTGATATTGATGGTAGTCGCGTGCCACATATAGTTCGTAGGAATCTTTCA 360
Patient 1     TTCTTTACATTTGATATTGATGGTAGTCGTGTGCCACATATAGTTCGTAAGAACCTCTCA 360
              ******* ********************* ******************* *** ** ***

Patient 7     AAGTATACTATGTTAGATCTTTGCTATGCATTGCGTCATTTTGATCGTAATGATTGTTCA 420
Patient 9     AAGTATACTATGTTAGATCTTTGCTATGCATTGCGTCATTTTGATCGTAATGATTGTTCA 420
Patient 10    AAGTATACTATGTTAGATCTTTGCTATGCATTGCGTCATTTTGATCGTAATGATTGTTCA 420
Patient 6     AAGTATACTATGTTAGATCTTTGCTATGCATTGCGTCATTTTGATCGTAATGATTGTTCA 420
Patient 4     AAGTATACTATGTTAGATCTTTGCTATGCATTGCGTCATTTTGATCGTAATGATTGTTCA 420
Patient 8     AAGTATACTATGTTAGATCTTTGCTATGCATTGCGTCATTTTGATCGTAATGATTGTTCA 420
Patient 2     AAGTATACTATGTTAGATCTTTGCTATGCATTGCGTCATTTTGATCGTAATGATTGTTCA 420
Patient 5     AAGTATACTATGTTAGATCTTTGCTATGCATTGCGTCATTTTGATCGTAATGATTGTTCA 420
```

FIG. 11

```
Patient 1       AAGTATACTATGTTAGATCTTTGCTATGCATTGCGCCATTTTGATTGTAATGATTGTTCA 420
                *********************************** ********* **************

Patient 7       ATATTGTGTGAAATTCTTTGTGAGTATGCTGATTGTAAAGAATCCTACTTTTCTAAGAAA 480
Patient 9       ATATTGTGTGAAATTCTTTGTGAGTATGCTGATTGTAAAGAATCCTACTTTTCTAAGAAA 480
Patient 10      ATATTGTGTGAAATTCTTTGTGAGTATGCTGATTGTAAAGAATCCTACTTTTCTAAGAAA 480
Patient 6       ATATTGTGTGAAATTCTTTGTGAGTATGCTGATTGTAAAGAATCCTACTTTTCTAAGAAA 480
Patient 4       ATATTGTGTGAAATTCTTTGTGAGTATGCTGATTGTAAAGAATCCTACTTTTCTAAGAAA 480
Patient 8       ATATTGTGTGAAATTCTTTGTGAGTATGCTGATTGTAAAGAATCCTACTTTTCTAAGAAA 480
Patient 2       ATATTGTGTGAAATTCTTTGTGAGTATGCTGATTGTAAAGAATCCTACTTTTCTAAGAAA 480
Patient 5       ATATTGTGTGAAATTCTTTGTGAGTATGCTGATTGTAAAGAATCCTACTTTTCTAAGAAA 480
Patient 1       GTATTGTGTGAAATTCTTTGTGAGTATGCTGATTGTAAAGAATCCTACTTTTCTAAGAAA 480
                 ***********************************************************

Patient 7       GATTGGTATGATTTTGTTGAAAATCCTGATATTATTAATATATATAAAAAATTAGGCCCT 540
Patient 9       GATTGGTATGATTTTGTTGAAAATCCTGATATTATTAATATATATAAAAAATTAGGCCCT 540
Patient 10      GATTGGTATGATTTTGTTGAAAATCCTGATATTATTAATATATATAAAAAATTAGGCCCT 540
Patient 6       GATTGGTATGATTTTGTTGAAAATCCTGATATTATTAATATATATAAAAAATTAGGCCCT 540
Patient 4       GATTGGTATGATTTTGTTGAAAATCCTGATATTATTAATATATATAAAAAATTAGGCCCT 540
Patient 8       GATTGGTATGATTTTGTTGAAAATCCTGATATTATTAATATATATAAAAAATTAGGTCCT 540
Patient 2       GATTGGTATGATTTTGTTGAAAATCCTGATATTATTAATATATATAAAAAATTAGGCCCT 540
Patient 5       GATTGGTATGATTTTGTTGAAAATCCTGATATTATTAATATATATAAAAAATTAGGCCCT 540
Patient 1       GATTGGTATGATTTTGTTGAAAATCCTGATATTATTAATATTTATAAAAAATTAGGCCCT 540
                ***************************************** ************** ***

Patient 7       ATTTTTAATAGAGCTTTACTTAATACTGTCATTTTTGCAGACACCTTAGTTGAAGTAGGT 600
Patient 9       ATTTTTAATAGAGCTTTACTTAATACTGTCATTTTTGCAGACACCTTAGTTGAAGTAGGT 600
Patient 10      ATTTTTAATAGAGCTTTACTTAATACTGTCATTTTTGCAGACACCTTAGTTGAAGTAGGT 600
Patient 6       ATTTTTAATAGAGCTTTACTTAATACTGTCATTTTTGCAGACACCTTAGTTGAAGTAGGT 600
Patient 4       ATTTTTAATAGAGCTTTACTTAATACTGTCATTTTTGCAGACACCTTAGTTGAAGTAGGT 600
Patient 8       ATTTTTAATAGAGCTTTACTTAATACTGTCATTTTTGCAGACACCTTAGTTGAAGTAGGT 600
Patient 2       ATTTTTAATAGAGCTTTACTTAATACTGTCATTTTTGCAGACACCTTAGTTGAAGTAGGT 600
Patient 5       ATTTTTAATAGAGCTTTACTTAATACTGTCATTTTTGCAGACACCTTAGTTGAAGTAGGT 600
Patient 1       ATTTTTAATAGAGCTTTACTTAATACTGTCAGTTTTGCAGATACTTTAGTAAAAGTAGGT 600
                ******************************* ********* ** *****  ********

Patient 7       TTAGTTGGTGTTTTAACTTTAGATAACCAAGATTTGTATGGTCAATGGTATGATTTTGGT 660
Patient 9       TTAGTTGGTGTTTTAACTTTAGATAACCAAGATTTGTATGGTCAATGGTATGATTTTGGT 660
Patient 10      TTAGTTGGTGTTTTAACTTTAGATAACCAAGATTTGTATGGTCAATGGTATGATTTTGGT 660
Patient 6       TTAGTTGGTGTTTTAACTTTAGATAACCAAGATTTGTATGGTCAATGGTATGATTTTGGT 660
Patient 4       TTAGTTGGTGTTTTAACTTTAGATAACCAAGATTTGTATGGTCAATGGTATGATTTTGGT 660
Patient 8       TTAGTTGGTGTTTTAACTTTAGATAACCAAGATTTGTATGGTCAATGGTATGATTTTGGT 660
Patient 2       TTAGTTGGTGTTTTAACTTTAGATAACCAAGATTTGTATGGTCAATGGTATGATTTTGGT 660
Patient 5       TTAGTTGGTGTTTTAACTTTAGATAACCAAGATTTGTATGGTCAATGGTATGATTTTGGT 660
Patient 1       TTAGTTGGTGTTTTAACTTTAGATAATCAAGACTTGTATGGTCAATGGTATGATTTTGGT 660
                ************************** ***** ***************************

Patient 7       GATTTTATACAAACAGCCCCAGGATTTGGTGTGGCAGTCGCAGATTCTTACTATTCTTAT 720
Patient 9       GATTTTATACAAACAGCCCCAGGATTTGGTGTGGCAGTCGCAGATTCTTACTATTCTTAT 720
Patient 10      GATTTTATACAAACAGCCCCAGGATTTGGTGTGGCAGTCGCAGATTCTTACTATTCTTAT 720
Patient 6       GATTTTATACAAACAGCCCCAGGATTTGGTGTGGCAGTCGCAGATTCTTACTATTCTTAT 720
Patient 4       GATTTTATACAAACAGCCCCAGGATTTGGTGTGGCAGTCGCAGATTCTTACTATTCTTAT 720
Patient 8       GATTTTATACAAACAGCCCCAGGATTTGGTGTGGCAGTCGCAGATTCTTACTATTCTTAT 720
Patient 2       GATTTTATACAAACAGCCCCAGGGTTTGGTGTGGCAGTTGCAGATTCTTACTTTTCTTAT 720
Patient 5       GATTTTATACAAACAGCCCCAGGGTTTGGTGTGGCAGTTGCAGATTCTTACTATTCTTAT 720
Patient 1       GATTTTATACAAACAGCTCCAGGTTTTGGTGTGGCAGTTGCAGATTCTTACTATTCTTAT 720
                ***************** ***** ************** ************ ********

Patient 7       ATGATGCCTATGTTGACTATGTGTCATGTATTAGATTGTGAATTATTTGTTAATGATAGT 780
Patient 9       ATGATGCCTATGTTGACTATGTGTCATGTATTAGATTGTGAATTATTTGTTAATGATAGT 780
Patient 10      ATGATGCCTATGTTGACTATGTGTCATGTATTAGATTGTGAATTATTTGTTAATGATAGT 780
Patient 6       ATGATGCCTATGTTGACTATGTGTCATGTATTAGATTGTGAATTATTTGTTAATGATAGT 780
Patient 4       ATGATGCCTATGTTGACTATGTGTCATGTATTAGATTGTGAATTATTTGTTAATGATAGT 780
Patient 8       ATGATGCCTATGTTAACTATGTGTCATGTATTAGATTGTGAATTATTTGTTAATGATAGT 780
Patient 2       ATGATGCCTATGTTGACTATGTGTCATGTATTAGATTGTGAATTATTTGTTAATGATAGT 780
Patient 5       ATGATGCCTATGTTGACTATGTGTCATGTATTAGATTGTGAATTATTTGTTAATGATAGT 780
Patient 1       ATGATGCCTATGTTGACTATGTGTCATGTATTAGATTGTGAATTATTTGTTAATGATAGT 780
                ************** *********************************************

Patient 7       TATAGACAATTCGATCTTGTGCAGTATGATTTTACTGATTACAAGTTAGAGTTGTTTAAT 840
Patient 9       TATAGACAATTCGATCTTGTGCAGTATGATTTTACTGATTACAAGTTAGAGTTGTTTAAT 840
Patient 10      TATAGACAATTCGATCTTGTGCAGTATGATTTTACTGATTACAAGTTAGAGTTGTTTAAT 840
Patient 6       TATAGACAATTCGATCTTGTGCAGTATGATTTTACTGATTACAAGTTAGAGTTGTTTAAT 840
Patient 4       TATAGACAATTCGATCTTGTGCAGTATGATTTTACTGATTACAAGTTAGAGTTGTTTAAT 840
Patient 8       TATAGACAATTCGATCTTGTACAGTATGATTTTACTGATTACAAGTTAGAGTTGTTTAAT 840
Patient 2       TATAGACAATTCGATCTTGTACAGTATGATTTTACTGATTACAAGTTAGAGTTGTTTAAT 840
```

FIG. 11 CONT.

```
Patient 5     TATAGACAATTCGATCTTGTACAGTATGATTTTACTGATTACAAGTTAGAGTTGTTTAAT 840
Patient 1     TATAGACAATTCGATCTTGTACAGTATGATTTTACTGATTATAAGTTAGAATTGTTTAAT 840
              ******************** ******************** ******** *********

Patient 7     AAGTATTTTAAGTATTGGGGTATGAAGTATCATCCTAATACTGTGGATTGTGATAATGAT 900
Patient 9     AAGTATTTTAAGTATTGGGGTATGAAGTATCATCCTAATACTGTGGATTGTGATAATGAT 900
Patient 10    AAGTATTTTAAGTATTGGGGTATGAAGTATCATCCTAATACTGTGGATTGTGATAATGAT 900
Patient 6     AAGTATTTTAAGTATTGGGGTATGAAGTATCATCCTAATACTGTGGATTGTGATAATGAT 900
Patient 4     AAGTATTTTAAGTATTGGGGTATGAAGTATCATCCTAATACTGTGGATTGTGATAATGAT 900
Patient 8     AAGTATTTTAAGTATTGGGGTATGAAGTATCATCCTAATACTGTGGATTGTGATAATGAT 900
Patient 2     AAGTATTTTAAGTATTGGGGTATGAAGTATCATCCTAATACTGTGGATTGTGATAATGAT 900
Patient 5     AAGTATTTTAAGTATTGGGGTATGAAGTATCATCCTAATACTGTGGATTGTGATAATGAT 900
Patient 1     AAGTATTTTAAGTATTGGGGTATGAAGTATCATCCTAATACTGTGGATTGTGATAATGAT 900
              ************************************************************

Patient 7     AGGTGTATTATTCATTGTGCTAATTTTAATATACTATTTAGTATGGTTTTACCTAATACT 960
Patient 9     AGGTGTATTATTCATTGTGCTAATTTTAATATACTATTTAGTATGGTTTTACCTAATACT 960
Patient 10    AGGTGTATTATTCATTGTGCTAATTTTAATATACTATTTAGTATGGTTTTACCTAATACT 960
Patient 6     AGGTGTATTATTCATTGTGCTAATTTTAATATACTATTTAGTATGGTTTTACCTAATACT 960
Patient 4     AGGTGTATTATTCATTGTGCTAATTTTAATATACTATTTAGTATGGTTTTACCTAATACT 960
Patient 8     AGGTGTATTATTCATTGTGCTAATTTTAATATACTATTTAGTATGGTTTTACCTAATACT 960
Patient 2     AGGTGTATTATTCATTGTGCTAATTTTAATATACTATTTAGTATGGTTTTACCTAATACT 960
Patient 5     AGGTGTATTATTCATTGTGCTAATTTTAATATACTATTTAGTATGGTTTTACCTAATACT 960
Patient 1     AGGTGTATTATTCATTGTGCTAATTTTAATATATTATTTAGTATGGTCTTACCTAATACT 960
              ********************************* ************* ************

Patient 7     TGTTTTGGTCCCCTTGTTAGACAAATTTTTGTAGATGGTGTACCGTTTGTTGTTTCTATT 1020
Patient 9     TGTTTTGGTCCCCTTGTTAGACAAATTTTTGTAGATGGTGTACCGTTTGTTGTTTCTATT 1020
Patient 10    TGTTTTGGTCCCCTTGTTAGACAAATTTTTGTAGATGGTGTACCGTTTGTTGTTTCTATT 1020
Patient 6     TGTTTTGGTCCCCTTGTTAGACAAATTTTTGTAGATGGTGTACCGTTTGTTGTTTCTATT 1020
Patient 4     TGTTTTGGTCCCCTTGTTAGACAAATTTTTGTAGATGGTGTACCGTTTGTTGTTTCTATT 1020
Patient 8     TGTTTTGGTCCCCTTGTTAGACAAATTTTTGTAGATGGTGTACCGTTTGTTGTTTCTATT 1020
Patient 2     TGTTTTGGTCCCCTTGTTAGACAAATTTTTGTAGATGGTGTACCGTTTGTTGTTTCTATT 1020
Patient 5     TGTTTTGGTCCCCTTGTTAGACAAATTTTTGTAGATGGTGTACCGTTTGTTGTTTCTATT 1020
Patient 1     TGTTTTGGTCCTCTTGTTAGACAAATTTTTGTAGATGGTGTTCCGTTTGTTGTTTCAATT 1020
              *********** ***************************** ************** ***

Patient 7     GGTTACCATTACAAAGAGTTAGGTGTAGTTATGAACTTAGATGTTGACACACACCGTTAT 1080
Patient 9     GGTTACCATTACAAAGAGTTAGGTGTAGTTATGAACTTAGATGTTGACACACACCGTTAT 1080
Patient 10    GGTTACCATTACAAAGAGTTAGGTGTAGTTATGAACTTAGATGTTGACACACACCGTTAT 1080
Patient 6     GGTTACCATTACAAAGAGTTAGGTGTAGTTATGAACTTAGATGTTGACACACACCGTTAT 1080
Patient 4     GGTTACCATTACAAAGAGTTAGGTGTAGTTATGAACTTAGATGTTGACACACACCGTTAT 1080
Patient 8     GGTTACCATTACAAAGAGTTAGGTGTAGTTATGAACTTAGATGTTGACACACACCGTTAT 1080
Patient 2     GGTTACCATTACAAAGAGTTAGGTGTAGTTATGAACTTAGATGTTGACACACACCGTTAT 1080
Patient 5     GGTTACCATTACAAAGAGTTAGGTGTAGTTATGAACTTAGATGTTGACACACACCGTTAT 1080
Patient 1     GGTTACCATTATAAAGAGTTAGGTGTAGTTATGAACTTGGATGTTGATACACACCGCTAT 1080
              *********** ************************** ******** ******** ***

Patient 7     CGTTTGTCTCTTAAAGATTTACTTCTTTATGCAGCAGATCCTGCTATGCATGTTGCATCT 1140
Patient 9     CGTTTGTCTCTTAAAGATTTACTTCTTTATGCAGCAGATCCTGCTATGCATGTTGCATCT 1140
Patient 10    CGTTTGTCTCTTAAAGATTTACTTCTTTATGCAGCAGATCCTGCTATGCATGTTGCATCT 1140
Patient 6     CGTTTGTCTCTTAAAGATTTACTTCTTTATGCAGCAGATCCTGCTATGCATGTTGCATCT 1140
Patient 4     CGTTTGTCTCTTAAAGATTTACTTCTTTATGCAGCAGATCCTGCTATGCATGTTGCATCT 1140
Patient 8     CGCTTGTCTCTTAAAGATTTACTTCTTTATGCAGCAGATCCTGCTATGCATGTTGCATCT 1140
Patient 2     CGTTTGTCTCTTAAAGATTTACTTCTTTATGCAGCAGATCCTGCTATGCACGTTGCATCT 1140
Patient 5     CGTTTGTCTCTTAAAGATTTACTTCTTTATGCAGCAGATCCTGCTATGCACGTTGCATCT 1140
Patient 1     CGTTTGTCTCTTAAAGACTTACTTCTTTATGCAGCAGATCCTGCTATGCATGTTGCATCT 1140
              ** ************** ******************************** *********

Patient 7     GCTAGTGCTCTGCTTGATTTACGAACTTGTTGTTTTAGTGTAGCTGCCATTACAAGTGGT 1200
Patient 9     GCTAGTGCTCTGCTTGATTTACGAACTTGTTGTTTTAGTGTAGCTGCCATTACAAGTGGT 1200
Patient 10    GCTAGTGCTCTGCTTGATTTACGAACTTGTTGTTTTAGTGTAGCTGCCATTACAAGTGGT 1200
Patient 6     GCTAGTGCTCTGCTTGATTTACGAACTTGTTGTTTTAGTGTAGCTGCCATTACAAGTGGT 1200
Patient 4     GCTAGTGCTCTGCTTGATTTACGAACTTGTTGTTTTAGTGTAGCTGCCATTACAAGTGGT 1200
Patient 8     GCTAGTGCTCTGCTTGATTTACGAACTTGTTGTTTTAGTGTAGCTGCCATTACAAGTGGT 1200
Patient 2     GCTAGTGCTCTGCTTGATTTACGAACTTGTTGTTTTAGTGTAGCTGCCATTACAAGTGGT 1200
Patient 5     GCTAGTGCTCTGCTTGATTTACGAACTTGTTGTTTTAGTGTAGCTGCCATTACAAGTGGT 1200
Patient 1     GCTAGTGCTCTGCTTGATTTACGAACTTGTTGTTTTAGTGTAGCTGCCATTACAAGTGGT 1200
              ************************************************************

Patient 7     ATAAAATTTCAAACTGTAAAACCAGGTAACTTTAACCAAGACTTTTACGAGTTTGTTAAA 1260
Patient 9     ATAAAATTTCAAACTGTAAAACCAGGTAACTTTAACCAAGACTTTTACGAGTTTGTTAAA 1260
Patient 10    ATAAAATTTCAAACTGTAAAACCAGGTAACTTTAACCAAGACTTTTACGAGTTTGTTAAA 1260
Patient 6     ATAAAATTTCAAACTGTAAAACCAGGTAACTTTAACCAAGACTTTTACGAGTTTGTTAAA 1260
Patient 4     ATAAAATTTCAAACTGTAAAACCAGGTAACTTTAACCAAGACTTTTACGAGTTTGTTAAA 1260
Patient 8     ATAAAATTTCAAACTGTTAAACCAGGTAACTTTAACCAAGACTTTTACGAGTTTGTTAAA 1260
```

FIG. 11 CONT.

```
Patient 2     ATAAAATTTCAAACTGTAAAACCAGGTAACTTTAACCAAGACTTTTACGAGTTTGTTAAA 1260
Patient 5     ATAAAATTTCAAACTGTAAAACCAGGTAACTTTAACCAAGACTTTTACGAGTTTGTTAAA 1260
Patient 1     ATAAAGTTTCAAACTGTTAAACCAGGTAATTTTAACCAAGATTTTTATGAGTTTGTCAAA 1260
              ***** *********** *********** *********** ***** ******** ***

Patient 7     AGTAAAGGCTTGTTTAAAGAGGGTAGTACAGTTGATTTGAAACATTTTTTCTTTACTCAA 1320
Patient 9     AGTAAAGGCTTGTTTAAAGAGGGTAGTACAGTTGATTTGAAACATTTTTTCTTTACTCAA 1320
Patient 10    AGTAAAGGCTTGTTTAAAGAGGGTAGTACAGTTGATTTGAAACATTTTTTCTTTACTCAA 1320
Patient 6     AGTAAAGGCTTGTTTAAAGAGGGTAGTACAGTTGATTTGAAACATTTTTTCTTTACTCAA 1320
Patient 4     AGTAAAGGCTTGTTTAAAGAGGGTAGTACAGTTGATTTGAAACATTTTTTCTTTACTCAA 1320
Patient 8     AGTAAAGGCTTGTTTAAAGAGGGTAGTACAGTTGATTTGAAACATTTTTTCTTTACTCAA 1320
Patient 2     AGTAAAGGCTTGTTTAAAGAGGGTAGTACAGTTGATTTGAAACATTTTTTCTTTACTCAA 1320
Patient 5     AGTAAAGGCTTGTTTAAAGAGGGTAGTACAGTTGATTTGAAACATTTTTTCTTTACTCAA 1320
Patient 1     AGTAAAGGCTTGTTTAAAGAGGGTAGTACAGTTGATTTGAAACACTTTTTCTTTACTCAA 1320
              ******************************************** ***************

Patient 7     GATGGTAATGCTGCAATTACTGATTATAATTATTATAAGTATAATTTACCTACTATGGTT 1380
Patient 9     GATGGTAATGCTGCAATTACTGATTATAATTATTATAAGTATAATTTACCTACTATGGTT 1380
Patient 10    GATGGTAATGCTGCAATTACTGATTATAATTATTATAAGTATAATTTACCTACTATGGTT 1380
Patient 6     GATGGTAATGCTGCAATTACTGATTATAATTATTATAAGTATAATTTACCTACTATGGTT 1380
Patient 4     GATGGTAATGCTGCAATTACTGATTATAATTATTATAAGTATAATTTACCTACTATGGTT 1380
Patient 8     GATGGTAATGCTGCAATTACTGATTATAATTATTATAAGTATAATTTACCTACTATGGTT 1380
Patient 2     GATGGTAATGCTGCAATTACTGATTATAATTATTATAAGTATAATTTACCTACTATGGTT 1380
Patient 5     GATGGTAATGCTGCAATTACTGATTATAATTATTATAAGTATAATTTACCTACTATGGTT 1380
Patient 1     GATGGTAATGCTGCAATTACTGATTATAATTATTATAAGTATAATTTACCTACTATGGTT 1380
              ************************************************************

Patient 7     GATATTAAGCAGTTATTGTTTGTATTAGAAGTTGTTTATAAATATTTTGAAATTTATGAT 1440
Patient 9     GATATTAAGCAGTTATTGTTTGTATTAGAAGTTGTTTATAAATATTTTGAAATTTATGAT 1440
Patient 10    GATATTAAGCAGTTATTGTTTGTATTAGAAGTTGTTTATAAATATTTTGAAATTTATGAT 1440
Patient 6     GATATTAAGCAGTTATTGTTTGTATTAGAAGTTGTTTATAAATATTTTGAAATTTATGAT 1440
Patient 4     GATATTAAGCAGTTATTGTTTGTATTAGAAGTTGTTTATAAATATTTTGAAATTTATGAT 1440
Patient 8     GATATTAAGCAGTTATTGTTTGTATTAGAAGTTGTTTATAAATATTTTGAAATTTATGAT 1440
Patient 2     GATATTAAGCAGTTATTGTTTGTATTAGAAGTTGTTTATAAATATTTTGAAATTTATGAT 1440
Patient 5     GATATTAAGCAGTTATTGTTTGTATTAGAAGTTGTTTATAAATATTTTGAAATTTATGAT 1440
Patient 1     GATATTAAGCAGTTATTGTTTGTATTAGAAGTTGTTTATAAGTATTTTGAAATTTATGAT 1440
              ****************************************** *****************

Patient 7     GGTGGTTGTATACCAGCATCACAAGTTATTGTTAATAATTATGATAAAAGTGCTGGTTAT 1500
Patient 9     GGTGGTTGTATACCAGCATCACAAGTCATTGTTAATAATTATGATAAAAGTGCTGGTTAT 1500
Patient 10    GGTGGTTGTATACCAGCATCACAAGTTATTGTTAATAATTATGATAAAAGTGCTGGTTAT 1500
Patient 6     GGTGGTTGTATACCAGCATCACAAGTTATTGTTAATAATTATGATAAAAGTGCTGGTTAT 1500
Patient 4     GGTGGTTGTATACCAGCATCACAAGTTATTGTTAATAATTATGATAAAAGTGCTGGTTAT 1500
Patient 8     GGTGGTTGTATACCAGCATCACAAGTTATTGTTAATAATTATGATAAAAGTGCTGGTTAT 1500
Patient 2     GGTGGTTGTATACCAGCATCACAAGTTATTGTTAATAATTATGATAAAAGTGCTGGTTAT 1500
Patient 5     GGTGGTTGTATACCAGCATCACAAGTTATTGTTAATAATTATGATAAAAGTGCTGGTTAT 1500
Patient 1     GGTGGTTGTATACCAGCATCACAAGTTATTGTTAATAATTATGACAAAAGTGCTGGTTAT 1500
              ************************** ***************** ***************

Patient 7     CCATTTAATAAATTTGGTAAAGCCAGACTTTATTATGAGGCATTATCATTTGAAGAACAG 1560
Patient 9     CCATTTAATAAATTTGGTAAAGCCAGACTTTATTATGAGGCATTATCATTTGAAGAACAG 1560
Patient 10    CCATTTAATAAATTTGGTAAAGCCAGACTTTATTATGAGGCATTATCATTTGAAGAACAG 1560
Patient 6     CCATTTAATAAATTTGGTAAAGCCAGACTTTATTATGAGGCATTATCATTTGAAGAACAG 1560
Patient 4     CCATTTAATAAATTTGGTAAAGCCAGACTTTATTATGAGGCATTATCATTTGAAGAACAG 1560
Patient 8     CCATTTAATAAATTTGGTAAAGCCAGACTTTATTATGAGGCATTATCATTTGAGGAACAG 1560
Patient 2     CCATTTAATAAATTTGGTAAAGCCAGACTTTATTATGAGGCATTATCATTTGAGGAACAG 1560
Patient 5     CCATTTAATAAATTTGGTAAAGCCAGACTTTATTATGAGGCATTATCATTTGAGGAACAG 1560
Patient 1     CCATTTAATAAATTTGGTAAAGCTAGACTTTATTATGAGGCATTATCATTTGAGGAGCAG 1560
              ********************** ***************************** ** ****

Patient 7     AATGAAATTTATGCATATACTAAACGTAATGTTCTGCCCACCTTAACTCAAATGAATTTA 1620
Patient 9     AATGAAATTTATGCATATACTAAACGTAATGTTCTGCCCACCTTAACTCAAATGAATTTA 1620
Patient 10    AATGAAATTTATGCATATACTAAACGTAATGTTCTGCCCACCTTAACTCAAATGAATTTA 1620
Patient 6     AATGAAATTTATGCATATACTAAACGTAATGTTCTGCCCACCTTAACTCAAATGAATTTA 1620
Patient 4     AATGAAATTTATGCATATACTAAACGTAATGTTCTGCCCACCTTAACTCAAATGAATTTA 1620
Patient 8     AATGAAATTTATGCATATACTAAACGTAATGTTCTGCCCACCTTAACTCAAATGAATTTA 1620
Patient 2     AATGAAATTTATGCATATACTAAACGTAATGTTCTGCCCACCTTAACTCAAATGAATTTA 1620
Patient 5     AATGAAATTTATGCATATACTAAACGTAATGTTCTGCCCACCTTAACTCAAATGAATTTA 1620
Patient 1     AATGAAATTTATGCATATACTAAACGTAATGTGTTGCCCACTTTAACTCAAATGAATTTA 1620
              ********************************  ******* ******************

Patient 7     AAATATGCTATCAGTGCTAAGAATAGAGCTCGCACTGTAGCAGGTGTTTCTATTCTTAGT 1680
Patient 9     AAATATGCTATCAGTGCTAAGAATAGAGCTCGCACTGTAGCAGGTGTTTCTATTCTTAGT 1680
Patient 10    AAATATGCTATCAGTGCTAAGAATAGAGCTCGCACTGTAGCAGGTGTTTCTATTCTTAGT 1680
Patient 6     AAATATGCTATCAGTGCTAAGAATAGAGCTCGCACTGTAGCAGGTGTTTCTATTCTTAGT 1680
Patient 4     AAATATGCTATCAGTGCTAAGAATAGAGCTCGCACTGTAGCAGGTGTTTCTATTCTTAGT 1680
```

FIG. 11 CONT.

```
Patient 8     AAATATGCTATCAGTGCTAAGAATAGAGCTCGCACTGTAGCAGGTGTTTCTATTCTTAGT 1680
Patient 2     AAATATGCTATCAGTGCTAAGAATAGAGCTCGCACTGTAGCAGGTGTTTCTATTCTTAGT 1680
Patient 5     AAATATGCTATCAGTGCTAAGAATAGAGCTCGCACTGTAGCAGGTGTTTCTATTCTTAGT 1680
Patient 1     AAATATGCTATTAGTGCTAAGAATAGAGCTCGTACTGTTGCAGGTGTTTCCATTCTTAGT 1680
              *********** ******************** ***** *********** *********

Patient 7     ACTATGACAGGCCGAATGTTCCATCAAAAATGTTTGAAGAGTATAGCAGCTACCCGAGGT 1740
Patient 9     ACTATGACAGGCCGAATGTTCCATCAAAAATGTTTGAAGAGTATAGCAGCTACCCGAGGT 1740
Patient 10    ACTATGACAGGCCGAATGTTCCATCAAAAATGTTTGAAGAGTATAGCAGCTACCCGAGGT 1740
Patient 6     ACTATGACAGGCCGAATGTTCCATCAAAAATGTTTGAAGAGTATAGCAGCTACCCGAGGT 1740
Patient 4     ACTATGACAGGCCGAATGTTCCATCAAAAATGTTTGAAGAGTATAGCAGCTACCCGAGGT 1740
Patient 8     ACTATGACAGGCCGAATGTTCCATCAAAAATGTTTGAAGAGTATAGCAGCCACCCGAGGT 1740
Patient 2     ACTATGACAGGCCGAATGTTCCATCAAAAATGTTTGAAGAGTATAGCAGCTACCCGAGGT 1740
Patient 5     ACTATGACAGGCCGAATGTTCCATCAAAAATGTTTGAAGAGTATAGCAGCTACCCGAGGT 1740
Patient 1     ACTATGACAGGTCGAATGTTTCATCAAAAATGTTTGAAGAGTATAGCAGCTACTCGTGGT 1740
              *********** ******** ***************************** ** ** ***

Patient 7     GTTCCTGTTGTTATAGGAACCACTAAATTTTATGGTGGTTGGGACGATATGTTACGTCAT 1800
Patient 9     GTTCCTGTTGTTATAGGAACCACTAAATTTTATGGTGGTTGGGACGATATGTTACGTCAT 1800
Patient 10    GTTCCTGTTGTTATAGGAACCACTAAATTTTATGGTGGTTGGGACGATATGTTACGTCAT 1800
Patient 6     GTTCCTGTTGTTATAGGAACCACTAAATTTTATGGTGGTTGGGACGATATGTTACGTCAT 1800
Patient 4     GTTCCTGTTGTTATAGGAACCACTAAATTTTATGGTGGTTGGGACGATATGTTACGTCAT 1800
Patient 8     GTTCCTGTTGTTATAGGAACCACTAAATTTTATGGTGGTTGGGACGATATGTTACGTCAT 1800
Patient 2     GTTCCTGTTGTTATAGGAACCACTAAATTTTATGGTGGTTGGGACGATATGTTACGTCAT 1800
Patient 5     GTTCCTGTTGTTATAGGAACCACTAAATTTTATGGTGGTTGGGACGATATGTTACGTCAT 1800
Patient 1     GTTCCTGTTGTTATAGGAACTACTAAATTTTATGGTGGCTGGGATGATATGTTACGCCAT 1800
              ******************** ***************** ***** *********** ***

Patient 7     CTTATAAAGGATGTTGACAACCCTGTTCTTATGGGTTGGGATTATCCTAAATGTGATCGT 1860
Patient 9     CTTATAAAGGATGTTGACAACCCTGTTCTTATGGGTTGGGATTATCCTAAATGTGATCGT 1860
Patient 10    CTTATAAAGGATGTTGACAACCCTGTTCTTATGGGTTGGGATTATCCTAAATGTGATCGT 1860
Patient 6     CTTATAAAGGATGTTGACAACCCTGTTCTTATGGGTTGGGATTATCCTAAATGTGATCGT 1860
Patient 4     CTTATAAAGGATGTTGACAACCCTGTTCTTATGGGTTGGGATTATCCTAAATGTGATCGT 1860
Patient 8     CTTATAAAGGATGTTGACAACCCTGTTCTTATGGGTTGGGATTATCCTAAATGTGATCGT 1860
Patient 2     CTTATAAAGGATGTTGACAACCCTGTTCTTATGGGTTGGGATTATCCTAAATGTGATCGT 1860
Patient 5     CTTATAAAGGATGTTGACAACCCTGTTCTTATGGGTTGGGATTATCCTAAATGTGATCGT 1860
Patient 1     CTTATAAAGGATGTTGACAACCCTGTTCTTATGGGTTGGGATTATCCTAAATGTGATCGT 1860
              ************************************************************

Patient 7     GCTATGCCAAATATTTTGCGTATTGTTAGTAGTTTAGTTTTGGCCCGCAAACATGAATTT 1920
Patient 9     GCTATGCCAAATATTTTGCGTATTGTTAGTAGTTTAGTTTTGGCCCGCAAACATGAATTT 1920
Patient 10    GCTATGCCAAATATTTTGCGTATTGTTAGTAGTTTAGTTTTGGCCCGCAAACATGAATTT 1920
Patient 6     GCTATGCCAAATATTTTGCGTATTGTTAGTAGTTTAGTTTTGGCCCGCAAACATGAATTT 1920
Patient 4     GCTATGCCAAATATTTTGCGTATTGTTAGTAGTTTAGTTTTGGCCCGCAAACATGAATTT 1920
Patient 8     GCTATGCCAAATATTTTGCGTATTGTTAGTAGTTTAGTTTTGGCCCGCAAACATGAATTT 1920
Patient 2     GCTATGCCAAATATTTTGCGTATTGTTAGTAGTTTAGTTTTGGCCCGCAAACATGAATTT 1920
Patient 5     GCTATGCCAAATATTTTGCGTATTGTTAGTAGTTTAGTTTTGGCCCGCAAACATGAATTT 1920
Patient 1     GCCATGCCAAATATTTTGCGTATTGTTAGTAGTTTAGTTTTGGCTCGTAAACATGAATTT 1920
              ** ***************************************** ** ************

Patient 7     TGTTGTTCACATGGTGATAGATTTTATCGCCTTGCGAATGAATGTGCTCAAGTTTTGAGT 1980
Patient 9     TGTTGTTCACATGGTGATAGATTTTATCGCCTTGCGAATGAATGTGCTCAAGTTTTGAGT 1980
Patient 10    TGTTGTTCACATGGTGATAGATTTTATCGCCTTGCGAATGAATGTGCTCAAGTTTTGAGT 1980
Patient 6     TGTTGTTCACATGGTGATAGATTTTATCGCCTTGCGAATGAATGTGCTCAAGTTTTGAGT 1980
Patient 4     TGTTGTTCACATGGTGATAGATTTTATCGCCTTGCGAATGAATGTGCTCAAGTTTTGAGT 1980
Patient 8     TGTTGTTCACATGGTGATAGATTCTATCGCCTTGCGAATGAATGTGCACAAGTTTTGAGT 1980
Patient 2     TGTTGTTCACATGGTGATAGATTTTATCGCCTTGCGAATGAATGTGCTCAAGTTTTGAGT 1980
Patient 5     TGTTGTTCACATGGTGATAGATTTTATCGCCTTGCGAATGAATGTGCTCAAGTTTTGAGT 1980
Patient 1     TGTTGTTCACATGGTGATAGATTCTATCGCCTTGCGAATGAATGTGCTCAAGTTTTGAGT 1980
              *********************** *********************** ************

Patient 7     GAAATAGTTATGTGTGGCGGTTGCTATTATGTTAAGCCTGGTGGTACTAGCAGTGGTGAT 2040
Patient 9     GAAATAGTTATGTGTGGCGGTTGCTATTATGTTAAGCCTGGTGGTACTAGCAGTGGTGAT 2040
Patient 10    GAAATAGTTATGTGTGGCGGTTGCTATTATGTTAAGCCTGGTGGTACTAGCAGTGGTGAT 2040
Patient 6     GAAATAGTTATGTGTGGCGGTTGCTATTATGTTAAGCCTGGTGGTACTAGCAGTGGTGAT 2040
Patient 4     GAAATAGTTATGTGTGGCGGTTGCTATTATGTTAAGCCTGGTGGTACTAGCAGTGGTGAT 2040
Patient 8     GAAATAGTTATGTGTGGCGGTTGCTATTATGTTAAGCCTGGTGGTACTAGCAGTGGTGAT 2040
Patient 2     GAAATAGTTATGTGTGGCGGTTGCTATTATGTTAAGCCTGGTGGTACTAGCAGTGGTGAT 2040
Patient 5     GAAATAGTTATGTGTGGCGGTTGCTATTATGTTAAGCCTGGTGGTACTAGCAGTGGTGAT 2040
Patient 1     GAAATAGTTATGTGTGGCGGTTGCTATTATGTTAAGCCTGGTGGTACTAGCAGTGGTGAT 2040
              ************************************************************

Patient 7     GCAACTACTGCTTTTGCTAATTCTGTTTTTAATATATGTCAGGCTGTTACTGCTAACGTT 2100
Patient 9     GCAACTACTGCTTTTGCTAATTCTGTTTTTAATATATGTCAGGCTGTTACTGCTAACGTT 2100
Patient 10    GCAACTACTGCTTTTGCTAATTCTGTTTTTAATATATGTCAGGCTGTTACTGCTAACGTT 2100
Patient 6     GCAACTACTGCTTTTGCTAATTCTGTTTTTAATATATGTCAGGCTGTTACTGCTAACGTT 2100
```

FIG. 11 CONT.

| | | |
|---|---|---|
| Patient 4  | GCAACTACTGCTTTTGCTAATTCTGTTTTTAATATATGTCAGGCTGTTACTGCTAACGTT | 2100 |
| Patient 8  | GCAACTACTGCTTTTGCTAATTCTGTTTTTAATATATGTCAGGCTGTTACTGCTAATGTT | 2100 |
| Patient 2  | GCAACTACTGCTTTTGCTAATTCTGTTTTTAATATATGTCAGGCTGTTACTGCTAATGTT | 2100 |
| Patient 5  | GCAACTACTGCTTTTGCTAATTCTGTTTTTAATATATGTCAGGCTGTTACTGCTAATGTT | 2100 |
| Patient 1  | GCAACCACTGCTTTTGCTAACTCTGTTTTTAATATATGTCAAGCTGTTACTGCTAATGTT | 2100 |
| | ***** ************* ********************* ************* *** | |
| | | |
| Patient 7  | TGTTCTCTTATGGCCTGTAATGGCCATAAGATTGAAGATTTAAGTATACGCAATTTACAA | 2160 |
| Patient 9  | TGTTCTCTTATGGCCTGTAATGGCCATAAGATTGAAGATTTAAGTATACGCAATTTACAA | 2160 |
| Patient 10 | TGTTCTCTTATGGCCTGTAATGGCCATAAGATTGAAGATTTAAGTATACGCAATTTACAA | 2160 |
| Patient 6  | TGTTCTCTTATGGCCTGTAATGGCCATAAGATTGAAGATTTAAGTATACGCAATTTACAA | 2160 |
| Patient 4  | TGTTCTCTTATGGCCTGTAATGGCCATAAGATTGAAGATTTAAGTATACGCAATTTACAA | 2160 |
| Patient 8  | TGTTCTCTTATGGCCTGTAATGGCCATAAGATTGAAGATTTAAGTATACGCAATTTACAA | 2160 |
| Patient 2  | TGTTCTCTTATGGCCTGTAATGGCCATAAGATTGAAGATTTAAGTATACGCAATTTACAA | 2160 |
| Patient 5  | TGTTCTCTTATGGCCTGTAATGGCCATAAGATTGAAGATTTAAGTATACGCAATTTACAA | 2160 |
| Patient 1  | TGTTCTCTTATGGCTTGTAATGGCCATAAGATTGAAGATTTAAGTATACGCAATTTACAA | 2160 |
| | ************** ********************************************* | |
| | | |
| Patient 7  | AAACGCTTATACTCTAATGTTTATCGTACAGATTATGTTGATTATACATTTGTTAATGAG | 2220 |
| Patient 9  | AAACGCTTATACTCTAATGTTTATCGTACAGATTATGTTGATTATACATTTGTTAATGAG | 2220 |
| Patient 10 | AAACGCTTATACTCTAATGTTTATCGTACAGATTATGTTGATTATACATTTGTTAATGAG | 2220 |
| Patient 6  | AAACGCTTATACTCTAATGTTTATCGTACAGATTATGTTGATTATACATTTGTTAATGAG | 2220 |
| Patient 4  | AAACGCTTATACTCTAATGTTTATCGTACAGATTATGTTGATTATACATTTGTTAATGAG | 2220 |
| Patient 8  | AAACGCTTATACTCTAATGTTTATCGTACAGATTATGTTGATTATACATTTGTTAATGAG | 2220 |
| Patient 2  | AAACGCTTATACTCTAATGTTTATCGTACAGATTATGTTGATTATACATTTGTTAATGAG | 2220 |
| Patient 5  | AAACGCTTATACTCTAATGTTTATCGTACAGATTATGTTGATTATACATTTGTTAATGAG | 2220 |
| Patient 1  | AAACGCTTATACTCTAATGTTTATCGTACAGATTATGTTGATTATACATTTGTTAATGAG | 2220 |
| | ************************************************************ | |
| | | |
| Patient 7  | TATTATGAATTTTTATGTAAGCATTTTAGTATGATGATTTTGAGTGATGATGGTGTTGTC | 2280 |
| Patient 9  | TATTATGAATTTTTATGTAAGCATTTTAGTATGATGATTTTGAGTGATGATGGTGTTGTC | 2280 |
| Patient 10 | TATTATGAATTTTTATGTAAGCATTTTAGTATGATGATTTTGAGTGATGATGGTGTTGTC | 2280 |
| Patient 6  | TATTATGAATTTTTATGTAAGCATTTTAGTATGATGATTTTGAGTGATGATGGTGTTGTC | 2280 |
| Patient 4  | TATTATGAATTTTTATGTAAGCATTTTAGTATGATGATTTTGAGTGATGATGGTGTTGTC | 2280 |
| Patient 8  | TATTATGAATTTTTATGTAAGCATTTTAGTATGATGATTTTGAGTGATGATGGTGTTGTC | 2280 |
| Patient 2  | TATTATGAATTTTTATGTAAGCATTTTAGTATGATGATTTTGAGTGATGATGGTGTTGTC | 2280 |
| Patient 5  | TATTATGAATTTTTATGTAAGCATTTTAGTATGATGATTTTGAGTGATGATGGTGTTGTC | 2280 |
| Patient 1  | TATTATGAATTTTTATGTAAGCATTTTAGTATGATGATTTTGAGTGATGATGGTGTTGTT | 2280 |
| | *********************************************************** | |
| | | |
| Patient 7  | TGTTATAACTCTGATTATGCTAGTAAGGGTTATATAGCTAATATAAGTGTTTTTCAACAA | 2340 |
| Patient 9  | TGTTATAACTCTGATTATGCTAGTAAGGGTTATATAGCTAATATAAGTGTTTTTCAACAA | 2340 |
| Patient 10 | TGTTATAACTCTGATTATGCTAGTAAGGGTTATATAGCTAATATAAGTGTTTTTCAACAA | 2340 |
| Patient 6  | TGTTATAACTCTGATTATGCTAGTAAGGGTTATATAGCTAATATAAGTGTTTTTCAACAA | 2340 |
| Patient 4  | TGTTATAACTCTGATTATGCTAGTAAGGGTTATATAGCTAATATAAGTGTTTTTCAACAA | 2340 |
| Patient 8  | TGTTATAACTCTGATTATGCTAATAAGGGTTATATAGCTAATATAAGTGCTTTTCAACAA | 2340 |
| Patient 2  | TGTTATAACTCTGATTATGCTAGTAAGGGTTATATAGCTAATATAAGTGTTTTTCAACAA | 2340 |
| Patient 5  | TGTTATAACTCTGATTATGCTAGTAAGGGTTATATAGCTAATATAAGTGTTTTTCAACAA | 2340 |
| Patient 1  | TGTTATAACTCTGATTATGCTAGTAAGGGTTATATAGCCAATATAAGTGTTTTTCAACAA | 2340 |
| | ********************** *************** ********* ********* | |
| | | |
| Patient 7  | GTTTTGTACTATCAGAATAATGTTTTTATGTCTGAATCTAAATGTTGGGTTGAAAATGAT | 2400 |
| Patient 9  | GTTTTGTACTATCAGAATAATGTTTTTATGTCTGAATCTAAATGTTGGGTTGAAAATGAT | 2400 |
| Patient 10 | GTTTTGTACTATCAGAATAATGTTTTTATGTCTGAATCTAAATGTTGGGTTGAAAATGAT | 2400 |
| Patient 6  | GTTTTGTACTATCAGAATAATGTTTTTATGTCTGAATCTAAATGTTGGGTTGAAAATGAT | 2400 |
| Patient 4  | GTTTTGTACTATCAGAATAATGTTTTTATGTCTGAATCTAAATGTTGGGTTGAAAATGAT | 2400 |
| Patient 8  | GTTTTGTACTATCAGAATAATGTCTTTATGTCTGAATCTAAATGTTGGGTTGAAAATGAT | 2400 |
| Patient 2  | GTTTTGTACTATCAGAATAATGTCTTTATGTCTGAATCTAAATGTTGGGTTGAAAATGAT | 2400 |
| Patient 5  | GTTTTGTACTATCAGAATAATGTCTTTATGTCTGAATCTAAATGTTGGGTTGAAAATGAT | 2400 |
| Patient 1  | GTTTTGTACTATCAGAATAACGTTTTTATGTCTGAATCTAAATGTTGGGTTGAAAATGAT | 2400 |
| | ******************** ** ************************************ | |
| | | |
| Patient 7  | ATTACTAATGGTCCTCATGAATTTTGTTCCCAACATACTATGTTGGTTAAGATAGATGGT | 2460 |
| Patient 9  | ATTACTAATGGTCCTCATGAATTTTGTTCCCAACATACTATGTTGGTTAAGATAGATGGT | 2460 |
| Patient 10 | ATTACTAATGGTCCTCATGAATTTTGTTCCCAACATACTATGTTGGTTAAGATAGATGGT | 2460 |
| Patient 6  | ATTACTAATGGTCCTCATGAATTTTGTTCCCAACATACTATGTTGGTTAAGATAGATGGT | 2460 |
| Patient 4  | ATTACTAATGGTCCTCATGAATTTTGTTCCCAACATACTATGTTGGTTAAGATAGATGGT | 2460 |
| Patient 8  | ATTACTAATGGTCCTCATGAATTTTGTTCCCAACATACTATGTTGGTTAAGATAGATGGT | 2460 |
| Patient 2  | ATTACTAATGGTCCTCATGAATTTTGTTCCCAACATACTATGTTAGTTAAGATAGATGGT | 2460 |
| Patient 5  | ATTACTAATGGTCCTCATGAATTTTGTTCCCAACATACTATGTTAGTTAAGATAGATGGT | 2460 |
| Patient 1  | ATTACTAATGGTCCTCATGAATTCTGTTCACAACATACTATGTTGGTTAAGATAGATGGT | 2460 |
| | *********************** ***** ************** ************** | |
| | | |
| Patient 7  | GATTATGTTTATTTACCATATCCAGATCCTTCTAGAATTCTAGGAGCTGGTTGTTTTGTT | 2520 |
| Patient 9  | GATTATGTTTATTTACCATATCCAGATCCTTCTAGAATTCTAGGAGCTGGTTGTTTTGTT | 2520 |
| Patient 10 | GATTATGTTTATTTACCATATCCAGATCCTTCTAGAATTCTAGGAGCTGGTTGTTTTGTT | 2520 |

FIG. 11 CONT.

```
Patient 6       GATTATGTTTATTTACCATATCCAGATCCTTCTAGAATTCTAGGAGCTGGTTGTTTTGTT 2520
Patient 4       GATTATGTTTATTTACCATATCCAGATCCTTCTAGAATTCTAGGAGCTGGTTGTTTTGTT 2520
Patient 8       GATTATGTTTATTTACCATATCCAGATCCTTCTAGAATCTTAGGAGCTGGTTGTTTTGTT 2520
Patient 2       GATTATGTTTATTTACCATATCCAGATCCTTCTAGAATTTTAGGAGCTGGTTGTTTTGTT 2520
Patient 5       GATTATGTTTATTTACCATATCCAGATCCTTCTAGAATTTTAGGAGCTGGTTGTTTTGTT 2520
Patient 1       GACTATGTTTATCTACCCTATCCAGACCCTTCTAGAATTTTAGGAGCTGGTTGTTTTGTT 2520
                ** ********* **** ******** ***********  ********************

Patient 7       GATGATTTATTGAAGACTGACAGTGTTCTTTTGATAGAGCGCTTTGTAAGTCTAGCTATA 2580
Patient 9       GATGATTTATTGAAGACTGATAGTGTTCTTTTGATAGAGCGCTTTGTAAGTCTAGCTATA 2580
Patient 10      GATGATTTATTGAAGACTGACAGTGTTCTTTTGATAGAGCGCTTTGTAAGTCTAGCTATA 2580
Patient 6       GATGATTTATTGAAGACTGACAGTGTTCTTTTGATAGAGCGCTTTGTAAGTCTAGCTATA 2580
Patient 4       GATGATTTATTGAAGACTGACAGTGTTCTTTTGATAGAGCGCTTTGTAAGTCTAGCTATA 2580
Patient 8       GATGATTTATTGAAGACTGACAGTGTTCTTTTGATAGAGCGCTTTGTAAGTCTAGCTATA 2580
Patient 2       GATGATTTATTGAAGACTGACAGTATTCTTTTGATAGAGCGCTTTGTAAGTCTAGCTATA 2580
Patient 5       GATGATTTATTGAAGACTGACAGTGTTCTTTTGATAGAGCGCTTTGTAAGTCTAGCTATA 2580
Patient 1       GATGATTTATTGAAGACTGACAGTGTTCTTTTGATAGAGCGCTTTGTAAGTCTAGCTATA 2580
                ******************** *** ***********************************

Patient 7       GATGCTTACCCTTTAGTATATCATGAAAATGAAGAATACCAAAAAGTCTTTCGTGTATAT 2640
Patient 9       GATGCTTACCCTTTAGTATATCATGAAAATGAAGAATACCAAAAAGTCTTTCGTGTATAT 2640
Patient 10      GATGCTTACCCTTTAGTATATCATGAAAATGAAGAATACCAAAAAGTCTTTCGTGTATAT 2640
Patient 6       GATGCTTACCCTTTAGTATATCATGAAAATGAAGAATACCAAAAAGTCTTTCGTGTATAT 2640
Patient 4       GATGCTTACCCTTTAGTATATCATGAAAATGAAGAATACCAAAAAGTCTTTCGTGTATAT 2640
Patient 8       GATGCTTACCCTTTAGTATATCATGAAAATGAAGAATACCAAAAAGTCTTTCGCGTATAT 2640
Patient 2       GATGCTTACCCTTTAGTACATCATGAAAATGAAGAATACCAAAAAGTCTTTCGTGTATAT 2640
Patient 5       GATGCTTACCCTTTAGTACATCATGAAAATGAAGAATACCAAAAAGTCTTTCGTGTATAT 2640
Patient 1       GATGCTTACCCTTTAGTACACCATGAAAATGAAGAATACCAAAAAGTTTTTCGTGTATAT 2640
                ****************** * ************************** ***** ******

Patient 7       TTAGAATATATAAAAAAACTGTATAATGATCTTGGTACTCAGATCTTAGATAGTTATAGT 2700
Patient 9       TTAGAATATATAAAAAAACTGTATAATGATCTTGGTACTCAGATCTTAGATAGTTATAGT 2700
Patient 10      TTAGAATATATAAAAAAACTGTATAATGATCTTGGTACTCAGATCTTAGATAGTTATAGT 2700
Patient 6       TTAGAATATATAAAAAAACTGTATAATGATCTTGGTACTCAGATCTTAGATAGTTATAGT 2700
Patient 4       TTAGAATATATAAAAAAACTGTATAATGATCTTGGTACTCAGATCTTAGATAGTTATAGT 2700
Patient 8       TTAGAATATATAAAAAAACTGTATAATGATCTTGGTACTCAGATCTTAGATAGTTATAGT 2700
Patient 2       TTAGAATATATAAAAAAACTGTATAATGATCTTGGTACTCAGATCTTAGATAGTTATAGT 2700
Patient 5       TTAGAATATATAAAAAAACTGTATAATGATCTTGGTACTCAGATCTTAGATAGTTATAGT 2700
Patient 1       TTAGAATATATAAAAAAACTATATAATGATCTTGGTAATCAGATCTTAGATAGTTATAGT 2700
                ******************** **************** **********************

Patient 7       GTTATTTTAAGTACTTGTGATGGTTTAAAGTTTACTGAAGAATCATTTTACAAGAATATG 2760
Patient 9       GTTATTTTAAGTACTTGTGATGGTTTAAAGTTTACTGAAGAATCATTTTACAAGAATATG 2760
Patient 10      GTTATTTTAAGTACTTGTGATGGTTTAAAGTTTACTGAAGAATCATTTTACAAGAATATG 2760
Patient 6       GTTATTTTAAGTACTTGTGATGGTTTAAAGTTTACTGAAGAATCATTTTACAAGAATATG 2760
Patient 4       GTTATTTTAAGTACTTGTGATGGTTTAAAGTTTACTGAAGAATCATTTTACAAGAATATG 2760
Patient 8       GTTATTTTAAGTACTTGTGATGGTTTAAAGTTTACTGAAGAATCATTTTACAAGAATATG 2760
Patient 2       GTTATTTTAAGTACTTGTGATGGTTTAAAGTTTACTGAAGAATCATTTTACAAGAATATG 2760
Patient 5       GTTATTTTAAGTACTTGTGATGGTTTAAAGTTTACTGAAGAATCATTTTACAAGAATATG 2760
Patient 1       GTTATTTTAAGTACTTGTGATGGTTTAAAGTTCACTGATGAATCATTTTATAAGAATATG 2760
                ******************************** ***** *********** *********

Patient 7       TATTTAAAAAGTGCCGTGATGCAG 2784
Patient 9       TATTTAAAAAGTGCCGTGATGCAG 2784
Patient 10      TATTTAAAAAGTGCCGTGATGCAG 2784
Patient 6       TATTTAAAAAGTGCCGTGATGCAG 2784
Patient 4       TATTTAAAAAGTGCCGTGATGCAG 2784
Patient 8       TATTTAAAAAGTGCCGTGATGCAG 2784
Patient 2       TATTTAAAAAGTGCCGTGATGCAG 2784
Patient 5       TATTTAAAAAGTGCCGTGATGCAG 2784
Patient 1       TATTTAAAAAGTGCCGTGATGCAG 2784
                ************************
```

FIG. 11 CONT.

Fig. 13. Multiple alignment of the spike genes of CoV-HKU1 from patients 1, 2, 4, 5, 6, 7, 8, 9, and 10.

```
Patient 6       ATGTTATTAATTATTTTTATTTTGCCTACAACATTAGCTGTTATAGGTGATTTTAATTGT 60
Patient 9       ATGTTATTAATTATTTTTATTTTGCCTACAACATTAGCTGTTATAGGTGATTTTAATTGT 60
Patient 10      ATGTTATTAATTATTTTTATTTTGCCTACAACATTAGCTGTTATAGGTGATTTTAATTGT 60
Patient 5       ATGTTATTAATTATTTTTATTTTGCCTACAACATTAGCTGTTATAGGTGATTTTAATTGT 60
Patient 4       ATGTTATTAATTATTTTTATTTTGCCTACAACATTAGCTGTTATAGGTGATTTTAATTGT 60
Patient 7       ATGTTATTAATTATTTTTATTTTGCCTACAACATTAGCTGTTATAGGTGATTTTAATTGT 60
Patient 2       ATGTTATTAATTATTTTTATTTTGCCTACAACATTAGCTGTTATAGGTGATTTTAATTGT 60
Patient 1       ATGTTTTTAATTATTTTTATTTTGCCTACAACACTAGCTGTTATAGGTGATTTTAATTGT 60
Patient 8       ATGTTTTTAATTATTTTTATTTTGCCTACAACACTAGCTGTTATAGGTGATTTTAATTGT 60
                ***** *************************** **************************

Patient 6       ACTAATTTTGCTATTAATGATTTAAACACCACAGTTCCTCGCATAAGTGAGTATGTTGTG 120
Patient 9       ACTAATTTTGCTATTAATGATTTAAACACCACAGTTCCTCGCATAAGTGAGTATGTTGTG 120
Patient 10      ACTAATTTTGCTATTAATGATTTAAACACCACAGTTCCTCGCATAAGTGAGTATGTTGTG 120
Patient 5       ACTAATTTTGCTATTAATGATTTAAACACCACAGTTCCTCGCATAAGTGAGTATGTTGTG 120
Patient 4       ACTAATTTTGCTATTAATGATTTAAACACCACAGTTCCTCGCATAAGTGAGTATGTTGTG 120
Patient 7       ACTAATTTTGCTATTAATGATTTAAACACCACAGTTCCTCGCATAAGTGAGTATGTTGTG 120
Patient 2       ACTAATTTTGCTATTAATGATTTAAACACCACAGTTCCTCGCATAAGTGAGTATGTTGTG 120
Patient 1       ACTAACTCTTTTATTAATGATTATAATAAAACCATTCCGCGTATAAGCGAGGATGTTGTT 120
Patient 8       ACTAACTCTTTTATTAATGATTATAATAAAACCATTCCGCGTATAAGCGAGGATGTTGTT 120
                ***** * *  ***********  ** *  **  **** ** ***** *** ******* 

Patient 6       GATGTTTCTTATGGTTTGGGTACATATTATATACTTGATCGTGTTTATTTAAATACTACT 180
Patient 9       GATGTTTCTTATGGTTTGGGTACATATTATATACTTGATCGTGTTTATTTAAATACTACT 180
Patient 10      GATGTTTCTTATGGTTTGGGTACATATTATATACTTGATCGTGTTTATTTAAATACTACT 180
Patient 5       GATGTTTCTTATGGTTTGGGTACATATTATATACTTGATCGTGTTTATTTAAATACTACT 180
Patient 4       GATGTTTCTTATGGTTTGGGTACATATTATATACTTGATCGTGTTTATTTAAATACTACT 180
Patient 7       GATGTTTCTTATGGTTTGGGTACATATTATATACTTGATCGTGTTTATTTAAATACTACT 180
Patient 2       GATGTTTCTTATGGTTTGGGTACATATTATATACTTGATCGTGTTTATTTAAATACTACT 180
Patient 1       GATGTATCTCTTGGTTTGGGCACATATTATGTTCTTAACCGTGTTTATTTAAATACTACC 180
Patient 8       GATGTATCTCTTGGTTTGGGCACATATTATGTTCTTAACCGTGTTTATTTAAATACTACC 180
                ***** ***  ********* ********* * *** * ******************** 

Patient 6       ATATTATTTACTGGTTATTTCCCTAAATCTGGTGCCAATTTTAGGGATCTATCTTTAAAA 240
Patient 9       ATATTATTTACTGGTTATTTCCCTAAATCTGGTGCCAATTTTAGGGATCTATCTTTAAAA 240
Patient 10      ATATTATTTACTGGTTATTTCCCTAAATCTGGTGCCAATTTTAGGGATCTATCTTTAAAA 240
Patient 5       ATATTATTTACTGGTTATTTCCCTAAATCTGGTGCCAATTTTAGGGATCTATCTTTAAAA 240
Patient 4       ATATTATTTACTGGTTATTTCCCTAAATCTGGTGCCAATTTTAGGGATCTATCTTTAAAA 240
Patient 7       ATATTATTTACTGGTTATTTCCCTAAATCTGGTGCCAATTTTAGGGATCTATCTTTAAAA 240
Patient 2       ATATTATTTACTGGTTATTTCCCTAAATCTGGTGCCAATTTTAGGGATCTATCTTTAAAA 240
Patient 1       TTGTTATTTACAGGTTATTTTCCTAAATCTGGTGCTAATTTTAGAGACTTGGCTTTAAAG 240
Patient 8       TTGTTATTTACGGGTTATTTTCCTAAATCTGGTGCTAACTTTAGAGACTTGGCTTTAAAG 240
                 * ******** ******** ************** ** ***** **  *  ******* 

Patient 6       GGTACTACATATTTGAGTACTCTTTGGTATCAGAAACCCTTTTTATCTGATTTTAATAAT 300
Patient 9       GGTACTACATATTTGAGTACTCTTTGGTATCAGAAACCCTTTTTATCTGATTTTAATAAT 300
Patient 10      GGTACTACATATTTGAGTACTCTTTGGTATCAGAAACCCTTTTTATCTGATTTTAATAAT 300
Patient 5       GGTACTACATATTTGAGTACTCTTTGGTATCAGAAACCCTTTTTATCTGATTTTAATAAT 300
Patient 4       GGTACTACATATTTGAGTACTCTTTGGTATCAGAAACCCTTTTTATCTGATTTTAATAAT 300
Patient 7       GGTACTACATATTTGAGTACTCTTTGGTATCAGAAACCCTTTTTATCTGATTTTAATAAT 300
Patient 2       GGTACTACATATTTGAGTACTCTTTGGTATCAGAAACCCTTTTTATCTGATTTTAATAAT 300
Patient 1       GGTTCTAAATATTTGAGTACTCTCTGGTATAAACCACCTTTTCTGTCAGATTTTAATAAT 300
Patient 8       GGTTCTATATATTTGAGTACTCTCTGGTATAAACCACCTTTTCTGTCAGATTTTAATAAT 300
                *** *** *************** ****** *   *** *** * ** ************

Patient 6       GGTATTTTTTCTAGAGTTAAGAATACTAAGTTGTATGTTAATAAAACTTTGTATAGTGAG 360
Patient 9       GGTATTTTTTCTAGAGTTAAGAATACTAAGTTGTATGTTAATAAAACTTTGTATAGTGAG 360
Patient 10      GGTATTTTTTCTAGAGTTAAGAATACTAAGTTGTATGTTAATAAAACTTTGTATAGTGAG 360
Patient 5       GGTATTTTTTCTAGAGTTAAGAATACTAAGTTGTATGTTAATAAAACTTTGTATAGTGAG 360
Patient 4       GGTATTTTTTCTAGAGTTAAGAATACTAAGTTGTATGTTAATAAAACTTTGTATAGTGAG 360
Patient 7       GGTATTTTTTCTAGAGTTAAGAATACTAAGTTGTATGTTAATAAAACTTTGTATAGTGAG 360
Patient 2       GGTATTTTTTCTAGAGTTAAGAATACTAAGTTGTATGTTAATAAAACTTTGTATAGTGAG 360
Patient 1       GGTATTTTTTCTAAGGTTAAGAATACTAAGTTATATGTTAATAATACTTTGTATAGTGAA 360
Patient 8       GGTATTTTTTCTAAGGTTAAGAATACTAAGTTATATGTTAATAATACTTTGTATAGTGAA 360
                *************  ***************** *********** ************** 

Patient 6       TTTAGTACTATAGTTATAGGTAGTGTTTTTATTAACAACTCTTATACTATTGTTGTTCAA 420
Patient 9       TTTAGTACTATAGTTATAGGTAGTGTTTTTATTAACAACTCTTATACTATTGTTGTTCAA 420
Patient 10      TTTAGTACTATAGTTATAGGTAGTGTTTTTATTAACAACTCTTATACTATTGTTGTTCAA 420
Patient 5       TTTAGTACTATAGTTATAGGTAGTGTTTTTATTAACAACTCTTATACTATTGTTGTTCAA 420
Patient 4       TTTAGTACTATAGTTATAGGTAGTGTTTTTATTAACAACTCTTATACTATTGTTGTTCAA 420
Patient 7       TTTAGTACTATAGTTATAGGTAGTGTTTTTATTAACAACTCTTATACTATTGTTGTTCAA 420
Patient 2       TTTAGTACTATAGTTATAGGTAGTGTTTTTATTAACAACTCTTATACTATTGTTGTTCAA 420
Patient 1       TTTAGTACTATAGTTATAGGTAGTGTTTTTGTTAATACTTCTTATACTATTGTTGTTCAA 420
```

FIG. 13

```
Patient 8     TTTAGTACTATAGTTATAGGTAGTGTTTTTGTTAATACTTCTTATACTATTGTTGTTCAA 420
              ****************************** **** *  *********************

Patient 6     CCTCATAATGGTGTTTTGGAGATTACAGCTTGTCAATACACTATGTGTGAGTATCCTCAT 480
Patient 9     CCTCATAATGGTGTTTTGGAGATTACAGCTTGTCAATACACTATGTGTGAGTATCCTCAT 480
Patient 10    CCTCATAATGGTGTTTTGGAGATTACAGCTTGTCAATACACTATGTGTGAGTATCCTCAT 480
Patient 5     CCTCATAATGGTGTTTTGGAGATTACAGCTTGTCAATACACTATGTGTGAGTATCCTCAT 480
Patient 4     CCTCATAATGGTGTTTTGGAGATTACAGCTTGTCAATACACTATGTGTGAGTATCCTCAT 480
Patient 7     CCTCATAATGGTGTTTTGGAGATTACAGCTTGTCAATACACTATGTGTGAGTATCCTCAT 480
Patient 2     CCTCATAATGGTGTTTTGGAGATTACAGCTTGTCAATACACTATGTGTGAGTATCCTCAT 480
Patient 1     CCTCACAATGGTATTTTGGAGATTACAGCTTGTCAGTATACTATGTGTGAATATCCTCAC 480
Patient 8     CCTCATAATGGTATTTTGGAGATTACAGCTTGTCAGTATACTATGTGTGAATATCCTCAC 480
              ***** ****** ********************** ** *********** ******** 

Patient 6     ACTATTTGTAAATCTAAAGGTAGTTCTCGTAATGAATCTTGGCATTTTGATAAATCTGAA 540
Patient 9     ACTATTTGTAAATCTAAAGGTAGTTCTCGTAATGAATCTTGGCATTTTGATAAATCTGAA 540
Patient 10    ACTATTTGTAAATCTAAAGGTAGTTCTCGTAATGAATCTTGGCATTTTGATAAATCTGAA 540
Patient 5     ACTATTTGTAAATCTAAAGGTAGTTCTCGTAATGAATCTTGGCATTTTGATAAATCTGAA 540
Patient 4     ACTATTTGTAAATCTAAAGGTAGTTCTCGTAATGAATCTTGGCATTTTGATAAATCTGAA 540
Patient 7     ACTATTTGTAAATCTAAAGGTAGTTCTCGTAATGAATCTTGGCATTTTGATAAATCTGAA 540
Patient 2     ACTATTTGTAAATCTAAAGGTAGTTCTCGTAATGAATCTTGGCATTTTGATAAATCTGAA 540
Patient 1     ACTGTTTGTAAGTCTAAGGGTAGTATTCGTAATGAATCTTGGCACATTGATTCTTCGGAA 540
Patient 8     ACTGTTTGTAAGTCTAAGGGTAGTATTCGTAATGAATCTTGGCACATTGATTCTTCGGAA 540
              *** ******* ***** ******  ******************  *****   ** ***

Patient 6     CCTTTGTGTCTGTTCAAGAAAAATTTTACTTATAATGTTTCTACAGATTGGTTGTATTTT 600
Patient 9     CCTTTGTGTCTGTTCAAGAAAAATTTTACTTATAATGTTTCTACAGATTGGTTGTATTTT 600
Patient 10    CCTTTGTGTCTGTTCAAGAAAAATTTTACTTATAATGTTTCTACAGATTGGTTGTATTTT 600
Patient 5     CCTTTGTGTCTGTTCAAGAAAAATTTTACTTATAATGTTTCTACAGATTGGTTGTATTTT 600
Patient 4     CCTTTGTGTCTGTTCAAGAAAAATTTTACTTATAATGTTTCTACAGATTGGTTGTATTTT 600
Patient 7     CCTTTGTGTCTGTTCAAGAAAAATTTTACTTATAATGTTTCTACAGATTGGTTGTATTTT 600
Patient 2     CCTTTGTGTCTGTTCAAGAAAAATTTTACTTATAATGTTTCTACAGATTGGTTGTATTTT 600
Patient 1     CCTTTATGCTTGTTTAAGAAAAATTTTACTTATAATGTTTCTGCAGATTGGCTGTATTTT 600
Patient 8     CCTTTATGCTTGTTTAAGAAAAATTTTACTTATAATGTTTCTGCAGATTGGCTGTATTTT 600
              ***** **  **** *************************** ******** ********

Patient 6     CATTTTTATCAAGAACGTGGCACTTTTTATGCTTATTATGCTGATTCTGGCATGCCTACT 660
Patient 9     CATTTTTATCAAGAACGTGGCACTTTTTATGCTTATTATGCTGATTCTGGCATGCCTACT 660
Patient 10    CATTTTTATCAAGAACGTGGCACTTTTTATGCTTATTATGCTGATTCTGGCATGCCTACT 660
Patient 5     CATTTTTATCAAGAACGTGGCACTTTTTATGCTTATTATGCTGATTCTGGCATGCCTACT 660
Patient 4     CATTTTTATCAAGAACGTGGCACTTTTTATGCTTATTATGCTGATTCTGGCATGCCTACT 660
Patient 7     CATTTTTATCAAGAACGTGGCACTTTTTATGCTTATTATGCTGATTCTGGCATGCCTACT 660
Patient 2     CATTTTTATCAAGAACGTGGCACTTTTTATGCTTATTATGCTGATTCTGGCATGCCTACT 660
Patient 1     CATTTTTATCAAGAACGTGGTGTTTTTTATGCATATTATGCAGATGTAGGTATGCCTACC 660
Patient 8     CATTTTTATCAAGAACGTGGTGTTTTTTATGCATATTATGCAGATGTAGGTATGCCTACC 660
              ********************   ********* ******** ***   ** ******** 

Patient 6     ACTTTTTTATTTAGTTTGTATCTTGGTACTCTTTTATCTCATTATTATGTTTTGCCTTTG 720
Patient 9     ACTTTTTTATTTAGTTTGTATCTTGGTACTCTTTTATCTCATTATTATGTTTTGCCTTTG 720
Patient 10    ACTTTTTTATTTAGTTTGTATCTTGGTACTCTTTTATCTCATTATTATGTTTTGCCTTTG 720
Patient 5     ACTTTTTTATTTAGTTTGTATCTTGGTACTCTTTTATCTCATTATTATGTTTTGCCTTTG 720
Patient 4     ACTTTTTTATTTAGTTTGTATCTTGGTACTCTTTTATCTCATTATTATGTTTTGCCTTTG 720
Patient 7     ACTTTTTTATTTAGTTTGTATCTTGGTACTCTTTTATCTCATTATTATGTTTTGCCTTTG 720
Patient 2     ACTTTTTTATTTAGTTTGTATCTTGGTACTCTTTTATCTCATTATTATGTTTTGCCTTTG 720
Patient 1     ACTTTCTTATTTAGTTTATATTTAGGTACTATTTTATCTCATTATTATGTTATGCCTTTG 720
Patient 8     ACTTTCTTATTTAGTCTATATTTAGGTACTATTTTATCTCATTATTATGTTATGCCTTTG 720
              ***** ********* * *** * ****** ******************** ********

Patient 6     ACTTGTAATGCTATATCTTCTAATACTGATAATGAGACTTTACAATATTGGGTCACACCT 780
Patient 9     ACTTGTAATGCTATATCTTCTAATACTGATAATGAGACTTTACAATATTGGGTCACACCT 780
Patient 10    ACTTGTAATGCTATATCTTCTAATACTGATAATGAGACTTTACAATATTGGGTCACACCT 780
Patient 5     ACTTGTAATGCTATATCTTCTAATACTGATAATGAGACTTTACAATATTGGGTCACACCT 780
Patient 4     ACTTGTAATGCTATATCTTCTAATACTGATAATGAGACTTTACAATATTGGGTCACACCT 780
Patient 7     ACTTGTAATGCTATATCTTCTAATACTGATAATGAGACTTTACAATATTGGGTCACACCT 780
Patient 2     ACTTGTAATGCTATATCTTCTAATACTGATAATGAGACTTTACAATATTGGGTTACACCT 780
Patient 1     ACTTGTAAGGCTATATCTTCAAATACTGACAATGAAACTTTAGAATATTGGGTTACACCG 780
Patient 8     ACTTGTAATGCTATATCTTCAAATACTGACAATGAAACTTTAGAATATTGGGTTACACCG 780
              ******** *********** ******** ***** ****** ********** ***** 

Patient 6     TTGTCTAAACGCCAATATCTTCTTAAATTTGACAACCGTGGTGTTATTACTAATGCTGTT 840
Patient 9     TTGTCTAAACGCCAATATCTTCTTAAATTTGACAACCGTGGTGTTATTACTAATGCTGTT 840
Patient 10    TTGTCTAAACGCCAATATCTTCTTAAATTTGACAACCGTGGTGTTATTACTAATGCTGTT 840
Patient 5     TTGTCTAAACGCCAATATCTTCTTAAATTTGACAACCGTGGTGTTATTACTAATGCTGTT 840
Patient 4     TTGTCTAAACGCCAATATCTTCTTAAATTTGACAACCGTGGTGTTATTACTAATGCTGTT 840
Patient 7     TTGTCTAAACGCCAATATCTTCTTAAATTTGACAACCGTGGTGTTATTACTAATGCTGTT 840
Patient 2     TTGTCTAAACGCCAATATCTTCTTAAATTTGACAACCGTGGTGTTATTACTAATGCTGTT 840
```

FIG. 13 CONT.

```
Patient 1     CTATCTAGACGTCAGTATCTTCTTAATTTTGATGAGCACGGTGTTATTACTAATGCCGTT 840
Patient 8     CTATCTAGACGTCAGTATCTTCTTAATTTTGATGAGCACGGTGTTATTACTAATGCCGTT 840
               * **** *** ** *********** *****  * *  **************** ***

Patient 6     GATTGTTCTAGTAGTTTCTTTAGCGAGATTCAATGTAAAACTAAATCTTTATTACCTAAT 900
Patient 9     GATTGTTCTAGTAGTTTCTTTAGCGAGATTCAATGTAAAACTAAATCTTTATTACCTAAT 900
Patient 10    GATTGTTCTAGTAGTTTCTTTAGCGAGATTCAATGTAAAACTAAATCTTTATTACCTAAT 900
Patient 5     GATTGTTCTAGTAGTTTCTTTAGCGAGATTCAATGTAAAACTAAATCTTTATTACCTAAT 900
Patient 4     GATTGTTCTAGTAGTTTCTTTAGCGAGATTCAATGTAAAACTAAATCTTTATTACCTAAT 900
Patient 7     GATTGTTCTAGTAGTTTCTTTAGCGAGATTCAATGTAAAACTAAATCTTTATTACCTAAT 900
Patient 2     GATTGTTCTAGTAGTTTCTTTAGCGAGATTCAATGTAAAACTAAATCTTTATTACCTAAT 900
Patient 1     GATTGTTCAAGTAGTTTTCTTAGTGAGATTCAATGTAAAACTCAATCTTTTGCACCTAAT 900
Patient 8     GATTGTTCAAGTAGTTTTCTTAGTGAGATTCAATGTAAAACTCAATCTTTTGCACCTAAT 900
              ******** ********  **** ****************** *******   *******

Patient 6     ACTGGTGTTTATGACTTATCTGGTTTTACTGTTAAGCCTGTTGCAACTGTACATCGTCGT 960
Patient 9     ACTGGTGTTTATGACTTATCTGGTTTTACTGTTAAGCCTGTTGCAACTGTACATCGTCGT 960
Patient 10    ACTGGTGTTTATGACTTATCTGGTTTTACTGTTAAGCCTGTTGCAACTGTACATCGTCGT 960
Patient 5     ACTGGTGTTTATGACTTATCTGGTTTTACTGTTAAGCCTGTTGCAACTGTACATCGTCGT 960
Patient 4     ACTGGTGTTTATGACTTATCTGGTTTTACTGTTAAGCCTGTTGCAACTGTACATCGTCGT 960
Patient 7     ACTGGTGTTTATGACTTATCTGGTTTTACTGTTAAGCCTGTTGCAACTGTACATCGTCGT 960
Patient 2     ACTGGTGTTTATGACTTATCTGGTTTTACTGTTAAGCCTGTTGCAACTGTACATCGTCGT 960
Patient 1     ACTGGTGTTTATGATTTGTCTGGTTTTACTGTAAAGCCTGTTGCAACTGTTTATCGTCGG 960
Patient 8     ACTGGTGTTTATGATTTGTCTGGTTTTACTGTAAAGCCTGTTGCAACTGTTTATCGTCGG 960
              ************** ** ************** ****************  *******

Patient 6     ATTCCTGATTTACCTGATTGTGACATTGATAAATGGCTTAACAATTTTAATGTACCCTCA 1020
Patient 9     ATTCCTGATTTACCTGATTGTGACATTGATAAATGGCTTAACAATTTTAATGTACCCTCA 1020
Patient 10    ATTCCTGATTTACCTGATTGTGACATTGATAAATGGCTTAACAATTTTAATGTACCCTCA 1020
Patient 5     ATTCCTGATTTACCTGATTGTGACATTGATAAATGGCTTAACAATTTTAATGTACCCTCA 1020
Patient 4     ATTCCTGATTTACCTGATTGTGACATTGATAAATGGCTTAACAATTTTAATGTACCCTCA 1020
Patient 7     ATTCCTGATTTACCTGATTGTGACATTGATAAATGGCTTAACAATTTTAATGTACCCTCA 1020
Patient 2     ATTCCTGATTTACCTGATTGTGACATTGATAAATGGCTTAACAATTTTAATGTACCCTCA 1020
Patient 1     ATTCCTAATTTACCTGATTGTGACATTGACAACTGGCTTAATAATGTTAGTGTACCTTCA 1020
Patient 8     ATTCCTAATTTACCTGATTGTGACATTGACAACTGGCTTAATAATGTTAGTGTACCTTCA 1020
              ****** ********************** ** ******** *** *** ****** ***

Patient 6     CCTCTTAATTGGGAACGTAAAATTTTTTCTAATTGCAACTTTAATTTGAGTACTTTGCTT 1080
Patient 9     CCTCTTAATTGGGAACGTAAAATTTTTTCTAATTGCAACTTTAATTTGAGTACTTTGCTT 1080
Patient 10    CCTCTTAATTGGGAACGTAAAATTTTTTCTAATTGCAACTTTAATTTGAGTACTTTGCTT 1080
Patient 5     CCTCTTAATTGGGAACGTAAAATTTTTTCTAATTGCAACTTTAATTTGAGTACTTTGCTT 1080
Patient 4     CCTCTTAATTGGGAACGTAAAATTTTTTCTAATTGCAACTTTAATTTGAGTACTTTGCTT 1080
Patient 7     CCTCTTAATTGGGAACGTAAAATTTTTTCTAATTGCAACTTTAATTTGAGTACTTTGCTT 1080
Patient 2     CCTCTTAATTGGGAACGTAAAATTTTTTCTAATTGCAACTTTAATTTGAGTACTTTGCTT 1080
Patient 1     CCTCTTAATTGGGAACGTAGAATTTTTTCTAATTGTAACTTCAATTTAAGCACTTTACTT 1080
Patient 8     CCTCTTAATTGGGAACGTAGAATTTTTTCTAATTGTAACTTTAACTTAAGCACTTTACTT 1080
              ******************* *************** ***** ** ** ** ***** ***

Patient 6     CGTTTAGTTCATACTGATTCTTTTTCTTGTAATAATTTTGATGAATCTAAGATATATGGT 1140
Patient 9     CGTTTAGTTCATACTGATTCTTTTTCTTGTAATAATTTTGATGAATCTAAGATATATGGT 1140
Patient 10    CGTTTAGTTCATACTGATTCTTTTTCTTGTAATAATTTTGATGAATCTAAGATATATGGT 1140
Patient 5     CGTTTAGTTCATACTGATTCTTTTTCTTGTAATAATTTTGATGAATCTAAGATATATGGT 1140
Patient 4     CGTTTAGTTCATACTGATTCTTTTTCTTGTAATAATTTTGATGAATCTAAGATATATGGT 1140
Patient 7     CGTTTAGTTCATACTGATTCTTTTTCTTGTAATAATTTTGATGAATCTAAGATATATGGT 1140
Patient 2     CGTTTAGTTCATACTGATTCTTTTTCTTGTAATAATTTTGATGAATCTAAGATATATGGT 1140
Patient 1     CGTCTAGTTCATGTTGATTCTTTTTCTTGTAATAATCTTGATAAATCTAAAATTTTTGGT 1140
Patient 8     CGTCTAGTTCATGTTGATTCTTTTTCTTGTAATAATCTTGATAAATCTAAAATTTTTGGT 1140
              *** ********  ********************** ***** ******* ** * ****

Patient 6     AGTTGTTTTAAGAGTATTGTTTTAGATAAATTTGCCATACCCAACTCCAGACGATCTGAT 1200
Patient 9     AGTTGTTTTAAGAGTATTGTTTTAGATAAATTTGCCATACCCAACTCCAGACGATCTGAT 1200
Patient 10    AGTTGTTTTAAGAGTATTGTTTTAGATAAATTTGCCATACCCAACTCCAGACGATCTGAT 1200
Patient 5     AGTTGTTTTAAGAGTATTGTTTTAGATAAATTTGCCATACCCAACTCCAGACGATCTGAT 1200
Patient 4     AGTTGTTTTAAGAGTATTGTTTTAGATAAATTTGCTATACCCAACTCCAGACGATCTGAT 1200
Patient 7     AGTTGTTTTAAGAGTATTGTTTTAGATAAATTTGCTATACCCAACTCCAGACGATCTGAT 1200
Patient 2     AGTTGTTTTAAGAGTATTGTTTTAGATAAATTTGCCATACCCAACTCCAGACGATCTGAT 1200
Patient 1     AGTTGCTTTAATAGTATTACTGTTGACAAGTTTGCTATACCTAATCGCAGACGAGATGAT 1200
Patient 8     AGTTGCTTTAATAGTATTACTGTTGACAAGTTTGCTATACCTAATCGCAGACGAGATGAT 1200
              ***** ***** ******  * * ** ** ***** ***** **   *******  ****

Patient 6     TTGCAGTTGGGCAGTTCTGGTTTTCTGCAATCTTCTAATTATAAAATTGACACTACTTCT 1260
Patient 9     TTGCAGTTGGGCAGTTCTGGTTTTCTGCAATCTTCTAATTATAAAATTGACACTACTTCT 1260
Patient 10    TTGCAGTTGGGCAGTTCTGGTTTTCTGCAATCTTCTAATTATAAAATTGACACTACTTCT 1260
Patient 5     TTGCAGTTGGGCAGTTCTGGTTTTCTGCAATCTTCTAATTATAAAATTGACACTACTTCT 1260
Patient 4     TTGCAGTTGGGCAGTTCTGGTTTTCTGCAATCTTCTAATTATAAAATTGACACTACTTCT 1260
Patient 7     TTGCAGTTGGGCAGTTCTGGTTTTCTGCAATCTTCTAATTATAAAATTGACACTACTTCT 1260
```

FIG. 13 CONT.

```
Patient 2     TTGCAGTTGGGCAGTTCTGGTTTTCTGCAATCTTCTAATTATAAAATTGACACTACTTCT 1260
Patient 1     TTGCAATTGGGCAGTTCTGGCTTTTGCAATCATCTAATTACAAAATAGATATTTCTTCT 1260
Patient 8     TTGCAATTGGGCAGTTCTGGCTTTTGCAATCATCTAATTACAAAATAGATATTTCTTCT 1260
              ***** ************** *** ******* ******** ***** ** * * *****

Patient 6     AGTTCTTGTCAATTGTATTATAGTTTGCCTGCAATTAATGTTACTATTAATAATTATAAT 1320
Patient 9     AGTTCTTGTCAATTGTATTATAGTTTGCCTGCAATTAATGTTACTATTAATAATTATAAT 1320
Patient 10    AGTTCTTGTCAATTGTATTATAGTTTGCCTGCAATTAATGTTACTATTAATAATTATAAT 1320
Patient 5     AGTTCTTGTCAATTGTATTATAGTTTGCCTGCAATTAATGTTACTATTAATAATTATAAT 1320
Patient 4     AGTTCTTGTCAATTGTATTATAGTTTGCCTGCAATTAATGTTACTATTAATAATTATAAT 1320
Patient 7     AGTTCTTGTCAATTGTATTATAGTTTGCCTGCAATTAATGTTACTATTAATAATTATAAT 1320
Patient 2     AGTTCTTGTCAATTGTATTATAGTTTGCCTGCAATTAATGTTACTATTAATAATTATAAT 1320
Patient 1     AGTTCTTGTCAATTGTATTATAGTTTACCTTTAGTTAATGTTACTATTAATAACTTTAAT 1320
Patient 8     AGTTCTTGTCAATTGTATTATAGTTTACCTTTAGTTAATGTTACTATTAATAACTTTAAT 1320
              ************************** ***  * ******************* * ****

Patient 6     CCTTCTTCTTGGAATAGAAGGTATGGTTTTAATAATTTTAATTTGAGCTCTCATAGTGTT 1380
Patient 9     CCTTCTTCTTGGAATAGAAGGTATGGTTTTAATAATTTTAATTTGAGCTCTCATAGTGTT 1380
Patient 10    CCTTCTTCTTGGAATAGAAGGTATGGTTTTAATAATTTTAATTTGAGCTCTCATAGTGTT 1380
Patient 5     CCTTCTTCTTGGAATAGAAGGTATGGTTTTAATAATTTTAATTTGAGCTCTCATAGTGTT 1380
Patient 4     CCTTCTTCTTGGAATAGAAGGTATGGTTTTAATAATTTTAATTTGAGCTCTCATAGTGTT 1380
Patient 7     CCTTCTTCTTGGAATAGAAGGTATGGTTTTAATAATTTTAATTTGAGCTCTCATAGTGTT 1380
Patient 2     CCTTCTTCTTGGAATAGAAGGTATGGTTTTAATAATTTTAATTTGAGCTCTCATAGTGTT 1380
Patient 1     CCATCTTCTTGGAATAGGAGGTATGGTTTTGGTAGTTTTAATGTGTCTTCTTATGACGTT 1380
Patient 8     CCATCTTCTTGGAATAGGAGGTATGGTTTTGGTAGTTTTAATTTGTCTTCTTATGACGTT 1380
              ** ************** ************  ** ******* **   *** **   ***

Patient 6     GTTTACTCACGTTATTGTTTTTCTGTTAATAATACTTTTTGTCCTTGTGCTAAACCTTCT 1440
Patient 9     GTTTACTCACGTTATTGTTTTTCTGTTAATAATACTTTTTGTCCTTGTGCTAAACCTTCT 1440
Patient 10    GTTTACTCACGTTATTGTTTTTCTGTTAATAATACTTTTTGTCCTTGTGCTAAACCTTCT 1440
Patient 5     GTTTACTCACGTTATTGTTTTTCTGTTAATAATACTTTTTGTCCTTGTGCTAAACCTTCT 1440
Patient 4     GTTTACTCACGTTATTGTTTTTCTGTTAATAATACTTTTTGTCCTTGTGCTAAACCTTCT 1440
Patient 7     GTTTACTCACGTTATTGTTTTTCTGTTAATAATACTTTTTGTCCTTGTGCTAAACCTTCT 1440
Patient 2     GTTTACTCACGTTATTGTTTTTCTGTTAATAATACTTTTTGTCCTTGTGCTAAACCTTCT 1440
Patient 1     GTTTATTCTGATCATTGTTTTTCTGTTAACAGCGACTTTTGCCCTTGTGCAGATCCGTCT 1440
Patient 8     GTTTATTCTGATCATTGTTTTTCTGTTAACAGCGACTTTTGCCCTTGTGCAGATCCGTCT 1440
              ***** **   * **************** *     ***** ********  * ** ***

Patient 6     TTTGCTTCAAGTTGCAAGAGTCATAAACCACCTTCTGCTTCCTGTCCTATTGGTACTAAT 1500
Patient 9     TTTGCTTCAAGTTGCAAGAGTCATAAACCACCTTCTGCTTCCTGTCCTATTGGTACTAAT 1500
Patient 10    TTTGCTTCAAGTTGCAAGAGTCATAAACCACCTTCTGCTTCCTGTCCTATTGGTACTAAT 1500
Patient 5     TTTGCTTCAAGTTGCAAGAGTCATAAACCACCTTCTGCTTCCTGTCCTATTGGTACTAAT 1500
Patient 4     TTTGCTTCAAGTTGCAAGAGTCATAAACCACCTTCTGCTTCCTGTCCTATTGGTACTAAT 1500
Patient 7     TTTGCTTCAAGTTGCAAGAGTCATAAACCACCTTCTGCTTCCTGTCCTATTGGTACTAAT 1500
Patient 2     TTTGCTTCAAGTTGCAAGAGTCATAAACCACCTTCTGCTTCCTGTCCTATTGGTACTAAT 1500
Patient 1     GTTGTTAATTCTTGTGTTAAATCTAAGCCTCTTTCTGCCATTTGTCCTGCTGGTACTAAA 1500
Patient 8     GTTGTTAATTCTTGTGCTAAATCTAAGCCTCCTTCTGCCATTTGTCCTGCTGGTACTAAA 1500
               *** *     ***    *    *** ** * ******    ******  *********

Patient 6     TATCGTTCTTGTGAGAGTACTACTGTACTCGACCACACTGATTGGTGTAGGTGTTCTTGT 1560
Patient 9     TATCGTTCTTGTGAGAGTACTACTGTACTCGACCACACTGACTGGTGTAGGTGTTCTTGT 1560
Patient 10    TATCGTTCTTGTGAGAGTACTACTGTACTCGACCACACTGACTGGTGTAGGTGTTCTTGT 1560
Patient 5     TATCGTTCTTGTGAGAGTACTACTGTACTCGACCACACTGACTGGTGTAGGTGTTCTTGT 1560
Patient 4     TATCGTTCTTGTGAGAGTACTACTGTACTCGACCACACTGACTGGTGTAGGTGTTCTTGT 1560
Patient 7     TATCGTTCTTGTGAGAGTACTACTGTACTCGACCACACTGACTGGTGTAGGTGTTCTTGT 1560
Patient 2     TATCGTTCTTGTGAGAGTACTACTGTACTCGACCACACTGACTGGTGTAGGTGTTCTTGT 1560
Patient 1     TATCGTCATTGCGACTTGGATACTACTCTTTATGTTAATAACTGGTGTAGATGTTCTTGT 1560
Patient 8     TATCGTCATTGCGACTTGGATACTACTCTTTATGTTAAAAACTGGTGTAGATGTTCTTGT 1560
              ******  *** **      ****   **  *    *   * ******** *********

Patient 6     TTACCTGATCCTATAACTGCTTATGACCCTAGGTCTTGTTCTCAAAAAAAGTCTCTGGTT 1620
Patient 9     TTACCTGATCCTATAACTGCTTATGACCCTAGGTCTTGTTCTCAAAAAAAGTCTCTGGTC 1620
Patient 10    TTACCTGATCCTATAACTGCTTATGACCCTAGGTCTTGTTCTCAAAAAAAGTCTCTGGTT 1620
Patient 5     TTACCTGATCCTATAACTGCTTATGACCCTAGGTCTTGTTCTCAAAAAAAGTCTCTGGTT 1620
Patient 4     TTACCTGATCCTATAACTGCTTATGACCCTAGGTCTTGTTCTCAAAAAAAGTCTCTGGTT 1620
Patient 7     TTACCTGATCCTATAACTGCTTATGACCCTAGGTCTTGTTCTCAAAAAAAGTCTCTGGTT 1620
Patient 2     TTACCTGATCCTATAACTGCTTATGACCCTAGGTCTTGTTCTCAAAAAAAGTCTCTGGTT 1620
Patient 1     CTACCTGACCCCATTTCTACTTATTCTCCTAACACATGTCCTCAAAAGAAGGTCGTTGTT 1620
Patient 8     CTACCTGACCCCATTTCTACTTATTCTCCTAACACATGTCCTCAAAAGAAGGTCGTTGTT 1620
               ******* ** **  ** *****   ****   * *** ******* ***    * **

Patient 6     GGTGTTGGTGAACATTGTGCAGGGTTCGGTGTTGATGAAGAAAAGTGTGGTGTATTGGAT 1680
Patient 9     GGTGTTGGTGAACATTGTGCAGGGTTCGGTGTTGATGAAGAAAAGTGTGGTGTATTGGAT 1680
Patient 10    GGTGTTGGTGAACATTGTGCAGGGTTCGGTGTTGATGAAGAAAAGTGTGGTGTATTGGAT 1680
Patient 5     GGTGTTGGTGAACATTGTGCAGGGTTCGGTGTTGATGAAGAAAAGTGTGGTGTATTGGAT 1680
Patient 4     GGTGTTGGTGAACATTGTGCAGGGTTCGGTGTTGATGAAGAAAAGTGTGGTGTATTGGAT 1680
```

FIG. 13 CONT.

```
Patient 7     GGTGTTGGTGAACATTGTGCAGGGTTCGGTGTTGATGAAGAAAAGTGTGGTGTATTGGAT 1680
Patient 2     GGTGTTGGTGAACATTGTGCAGGGTTCGGTGTTGATGAAGAAAAGTGTGGTGTATTGGAT 1680
Patient 1     GGTATAGGTGAACATTGTCCAGGTCTTGGTATTAATGAGGAAAAATGTGGTACAC----- 1675
Patient 8     GGTATAGGTGAACATTGTCCAGGTCTTGGTATTAATGAGGAAAAATGTGGTACAC----- 1675
              *** * ************ ****  * *** ** **** ***** ******  *

Patient 6     GGATCATATAATGTTTCTTGTCTTTGTAGTACTGATGCCTTTCTAGGTTGGTCTTATGAC 1740
Patient 9     GGATCATATAATGTTTCTTGTCTTTGTAGTACTGATGCCTTTCTAGGTTGGTCTTATGAC 1740
Patient 10    GGATCATATAATGTTTCTTGTCTTTGTAGTACTGATGCCTTTCTAGGTTGGTCTTATGAC 1740
Patient 5     GGATCATATAATGTTTCTTGTCTTTGTAGTACTGATGCCTTTCTAGGTTGGTCTTATGAC 1740
Patient 4     GGATCATATAATGTTTCTTGTCTTTGTAGTACTGATGCCTTTCTAGGTTGGTCTTATGAC 1740
Patient 7     GGATCATATAATGTTTCTTGTCTTTGTAGTACTGATGCCTTTCTAGGTTGGTCTTATGAC 1740
Patient 2     GGATCATATAATGTTTCTTGTCTTTGTAGTACTGATGCCTTTCTAGGTTGGTCTTATGAC 1740
Patient 1     -AATTAAATCATAGTTCCTGTTCTTGTAGTCCTGATGCCTTTTTGGGTTGGTCTTTTGAT 1734
Patient 8     -AATTAAATCATAGTTCCTGTTTTTGTAGTCCTGATGCCTTTTTGGGTTGGTCTTTTGAT 1734
                ** * ** **  *** ***  ******* *********** * ********** ***

Patient 6     ACTTGCGTCAGTAACAACCGTTGTAATATTTTTTCTAATTTTATTTTAAATGGTATCAAT 1800
Patient 9     ACTTGCGTCAGTAACAACCGTTGTAATATTTTTTCTAATTTTATTTTAAATGGTATCAAT 1800
Patient 10    ACTTGCGTCAGTAACAACCGTTGTAATATTTTTTCTAATTTTATTTTAAATGGTATCAAT 1800
Patient 5     ACTTGCGTCAGTAACAACCGTTGTAATATTTTTTCTAATTTTATTTTAAATGGTATCAAT 1800
Patient 4     ACTTGCGTCAGTAACAACCGTTGTAATATTTTTTCTAATTTTATTTTAAATGGTATCAAT 1800
Patient 7     ACTTGCGTCAGTAACAACCGTTGTAATATTTTTTCTAATTTTATTTTAAATGGTATCAAT 1800
Patient 2     ACTTGCGTCAGTAACAACCGTTGTAATATTTTTTCTAATTTTATTTTAAATGGTATCAAT 1800
Patient 1     AGTTGTATTAGTAATAATCGTTGCAATATTTTTTCTAATTTTATTTTTAATGGAATTAAT 1794
Patient 8     AGTTGTATTAGTAATAATCGTTGCAATATTTTTTCTAATTTTATTTTTAATGGAATTAAT 1794
              * ***  * ***** ** ***** *********************** ***** ** ***

Patient 6     AGTGGTACCACTTGTTCTAATGATTTATTGCAGCCTAATACTGAAGTTTTTACTGATGTT 1860
Patient 9     AGTGGTACCACTTGTTCTAATGATTTATTGCAGCCTAATACTGAAGTTTTTACTGATGTT 1860
Patient 10    AGTGGTACCACTTGTTCTAATGATTTATTGCAGCCTAATACTGAAGTTTTTACTGATGTT 1860
Patient 5     AGTGGTACCACTTGTTCTAATGATTTATTGCAGCCTAATACTGAAGTTTTTACTGATGTT 1860
Patient 4     AGTGGTACCACTTGTTCTAATGATTTATTGCAGCCTAATACTGAAGTTTTTACTGATGTT 1860
Patient 7     AGTGGTACCACTTGTTCTAATGATTTATTGCAGCCTAATACTGAAGTTTTTACTGATGTT 1860
Patient 2     AGTGGTACCACTTGTTCTAATGATTTATTGCAGCCTAATACTGAAGTTTTTACTGATGTT 1860
Patient 1     AGTGGCACCACTTGTTCTAATGATTTGTTATATTCTAACACTGAAGTTTCTACTGGTGTT 1854
Patient 8     AGTGGCACCACTTGTTCTAATGATTTGTTATATTCTAACACTGAAATTTCTACTGGTGTT 1854
              ***** ******************** **  *  **** ****** *** ***** ****

Patient 6     TGTGTTGATTACGACCTTTATGGTATTACAGGACAAGGTATTTTTAAAGAAGTTTCTGCT 1920
Patient 9     TGTGTTGATTACGACCTTTATGGTATTACAGGACAAGGTATTTTTAAAGAAGTTTCTGCT 1920
Patient 10    TGTGTTGATTACGACCTTTATGGTATTACAGGACAAGGTATTTTTAAAGAAGTTTCTGCT 1920
Patient 5     TGTGTTGATTACGACCTTTATGGTATTACAGGACAAGGTATTTTTAAAGAAGTTTCTGCT 1920
Patient 4     TGTGTTGATTACGACCTTTATGGTATTACAGGACAAGGTATTTTTAAAGAAGTTTCTGCT 1920
Patient 7     TGTGTTGATTACGACCTTTATGGTATTACAGGACAAGGTATTTTTAAAGAAGTTTCTGCT 1920
Patient 2     TGTGTTGATTACGACCTTTATGGTATTACAGGACAAGGTATTTTTAAAGAAGTTTCTGCT 1920
Patient 1     TGTGTTAATTATGATCTTTATGGCATCACAGGCCAAGGTATTTTTAAAGAAGTTTCTGCG 1914
Patient 8     TGTGTTAATTATGATCTTTATGGCATCACAGGCCAAGGTATTTTTAAAGAAGTTTCTGCG 1914
              ****** **** ** ******** ** ***** **************************

Patient 6     GTTTATTATAATAGTTGGCAAAATCTTTTGTATGATTCTAATGGCAACATTATTGGTTTT 1980
Patient 9     GTTTATTATAATAGTTGGCAAAATCTTTTGTATGATTCTAATGGCAACATTATTGGTTTT 1980
Patient 10    GTTTATTATAATAGTTGGCAAAATCTTTTGTATGATTCTAATGGCAACATTATTGGTTTT 1980
Patient 5     GTTTATTATAATAGTTGGCAAAATCTTTTGTATGATTCTAATGGCAACATTATTGGTTTT 1980
Patient 4     GTTTATTATAATAGTTGGCAAAATCTTTTGTATGATTCTAATGGCAACATTATTGGTTTT 1980
Patient 7     GTTTATTATAATAGTTGGCAAAATCTTTTGTATGATTCTAATGGCAACATTATTGGTTTT 1980
Patient 2     GTTTATTATAATAGTTGGCAAAATCTTTTGTATGATTCTAATGGCAACATTATTGGTTTT 1980
Patient 1     GCTTATTATAATAATTGGCAGAATCTTTTGTATGATTCTAATGGTAATATTATTGGTTTT 1974
Patient 8     GCTTATTATAATAATTGGCAGAATCTTTTGTATGATTCTAATGGTAATATTATTGGTTTT 1974
              * *********** ****** *********************** ** ************

Patient 6     AAAGATTTTGTTACTAATAAAACATATAATATTTTCCCTTGTTATGCAGGAAGAGTTTCT 2040
Patient 9     AAAGATTTTGTTACTAATAAAACATATAATATTTTCCCTTGTTATGCAGGAAGAGTTTCT 2040
Patient 10    AAAGATTTTGTTACTAATAAAACATATAATATTTTCCCTTGTTATGCAGGAAGAGTTTCT 2040
Patient 5     AAAGATTTTGTTACTAATAAAACATATAATATTTTCCCTTGTTATGCAGGAAGAGTTTCT 2040
Patient 4     AAAGATTTTGTTACTAATAAAACATATAATATTTTCCCTTGTTATGCAGGAAGAGTTTCT 2040
Patient 7     AAAGATTTTGTTACTAATAAAACATATAATATTTTCCCTTGTTATGCAGGAAGAGTTTCT 2040
Patient 2     AAAGATTTTGTTACTAATAAAACATATAATATTTTCCCTTGTTATGCAGGAAGAGTTTCT 2040
Patient 1     AAAGATTTTTTGACTAATAAAACTTACACTATACTTCCTTGTTATTCTGGTAGAGTGTCT 2034
Patient 8     AAAGATTTTTTGACTAATAAAACTTACACTATACTTCCTTGTTATTCTGGTAGAGTGTCT 2034
              ********* * *********** ** * ***  * ********* * ** ***** ***

Patient 6     GCTGCTTTTCATCAAAATGCTTCCTCTTTGGCTTTACTTTATCGTAATTTAAAATGTAGC 2100
Patient 9     GCTGCTTTTCATCAAAATGCTTCCTCTTTGGCTTTACTTTATCGTAATTTAAAATGTAGC 2100
Patient 10    GCTGCTTTTCATCAAAATGCTTCCTCTTTGGCTTTACTTTATCGTAATTTAAAATGTAGC 2100
Patient 5     GCTGCTTTTCATCAAAATGCTTCCTCTTTGGCTTTACTTTATCGTAATTTAAAATGTAGC 2100
```

FIG. 13 CONT.

```
Patient 4      GCTGCTTTTCATCAAAATGCTTCCTCTTTGGCTTTACTTTATCGTAATTTAAAATGTAGC 2100
Patient 7      GCTGCTTTTCATCAAAATGCTTCCTCTTTGGCTTTACTTTATCGTAATTTAAAATGTAGC 2100
Patient 2      GCTGCTTTTCATCAAAATGCTTCCTCTTTGGCTTTACTTTATCGTAATTTAAAATGTAGC 2100
Patient 1      GCTGCATTTTATCAAAATTCTTCTTCACCAGCTTTGCTTTATCGTAATTTAAAGTGTAGT 2094
Patient 8      GCTGCATTTTATCAAAATTCTTCCTCACCAGCTTTGCTTTATCGTAATTTAAAGTGTAGT 2094
               ***** *** ******** **** **    ***** ***************** *****

Patient 6      TATGTTTTGAATAATATTTCTTTAGCTACTCAGCCAT---ATTTTGATAGTTATCTTGGT 2157
Patient 9      TATGTTTTGAATAATATTTCTTTAGCTACTCAGCCAT---ATTTTGATAGTTATCTTGGT 2157
Patient 10     TATGTTTTGAATAATATTTCTTTAGCTACTCAGCCAT---ATTTTGATAGTTATCTTGGT 2157
Patient 5      TATGTTTTGAATAATATTTCTTTAACTACTCAGCCAT---ATTTTGATAGTTATCTTGGT 2157
Patient 4      TATGTTTTGAATAATATTTCTTTAGCTACTCAGCCAT---ATTTTGATAGTTATCTTGGT 2157
Patient 7      TATGTTTTGAATAATATTTCTTTAGCTACTCAGCCAT---ATTTTGATAGTTATCTTGGT 2157
Patient 2      TATGTTTTGAATAATATTTCTTTAGCTACTCAGCCAT---ATTTTGATAGTTATCTTGGT 2157
Patient 1      TATGTTTTGAATAATATTTCTTTTATCTCACAACCATTTTATTTTGATAGTTATCTTGGT 2154
Patient 8      TATGTTTTGAATAATATTTCTTTTATCTCACAACCATTTTATTTCGATAGTTATCTTGGT 2154
               ***********************     * ** ****   **** ***************

Patient 6      TGCGTTTTTAATGCTGATAATTTAACTGATTATTCTGTTTCTTCTTGTGCTCTTCGCATG 2217
Patient 9      TGCGTTTTTAATGCTGATAATTTAACTGATTATTCTGTTTCTTCTTGTGCTCTTCGCATG 2217
Patient 10     TGCGTTTTTAATGCTGATAATTTAACTGATTATTCTGTTTCTTCTTGTGCTCTTCGCATG 2217
Patient 5      TGCGTTTTTAATGCTGATAATTTAACTGATTATTCTGTTTCTTCTTGTGCTCTTCGCATG 2217
Patient 4      TGCGTTTTTAATGCTGATAATTTAACTGATTATTCTGTTTCTTCTTGTGCTCTTCGCATG 2217
Patient 7      TGCGTTTTTAATGCTGATAATTTAACTGATTATTCTGTTTCTTCTTGTGCTCTTCGCATG 2217
Patient 2      TGCGTTTTTAATGCTGATAATTTAACTGATTATTCTGTTTCTTCTTGTGCTCTTCGCATG 2217
Patient 1      TGTGTTTTGAATGCTGTTAATTTAACTAGCTATTCTGTATCCTCTTGTGATTTGCGTATG 2214
Patient 8      TGTGTTTTGAATGCTGTTAATTTAACTAGCTATTCTGTATCCTCTTGTGATTTGCGTATG 2214
               ** ***** ******* **********   ******** ** ******* * * ** ***

Patient 6      GGTAGTGGTTTTTGTGTTGATTATAACTCACCTTCTTCTTCCTCTTCGCGTCGTAAACGT 2277
Patient 9      GGTAGTGGTTTTTGTGTTGATTATAACTCACCTTCTTCTTCCTCTTCGCGTCGTAAACGT 2277
Patient 10     GGTAGTGGTTTTTGTGTTGATTATAACTCACCTTCTTCTTCCTCTTCGCGTCGTAAACGT 2277
Patient 5      GGTAGTGGTTTTTGTGTTGATTATAACTCACCTTCTTCTTCCTCTTCGCGTCGTAAACGT 2277
Patient 4      GGTAGTGGTTTTTGTGTTGATTATAACTCACCTTCTTCTTCCTCTTCGCGTCGTAAACGT 2277
Patient 7      GGTAGTGGTTTTTGTGTTGATTATAACTCACCTTCTTCTTCCTCTTCGCGTCGTAAACGT 2277
Patient 2      GGTAGTGGTTTTTGTGTTGATTATAACTCACCTTCTTCTTCCTCTTCGCGTCGTAAACGT 2277
Patient 1      GGTAGTGGGTTTTGTATTGATTATGCTTTACCCTCTTCT---------CGGCGTAAGCGT 2265
Patient 8      GGTAGTGGATTTTGTATTGATTATGCTTTACCCTCTTCT---------CGGCGTAAGCGT 2265
               ******** ****** ********   * *** ******         ** ***** ***

Patient 6      AGAAGTATTTCTGCTTCTTATCGTTTTGTTACTTTTGAACCCTTTAATGTCAGTTTTGTT 2337
Patient 9      AGAAGTATTTCTGCTTCTTATCGTTTTGTTACTTTTGAACCCTTTAATGTCAGTTTTGTT 2337
Patient 10     AGAAGTATTTCTGCTTCTTATCGTTTTGTTACTTTTGAACCCTTTAATGTCAGTTTTGTT 2337
Patient 5      AGAAGTATTTCTGCTTCTTATCGTTTTGTTACTTTTGAACCCTTTAATGTCAGTTTTGTT 2337
Patient 4      AGAAGTATTTCTGCTTCTTATCGTTTTGTTACTTTTGAACCCTTTAATGTCAGTTTTGTT 2337
Patient 7      AGAAGTATTTCTGCTTCTTATCGTTTTGTTACTTTTGAACCCTTTAATGTCAGTTTTGTT 2337
Patient 2      AGAAGTATTTCTGCTTCTTATCGTTTTGTTACTTTTGAACCCTTTAATGTCAGTTTTGTT 2337
Patient 1      AGAGGTATTTCTTCTCCTTATCGCTTTGTAACTTTTGAACCCTTTAATGTTAGTTTTGTT 2325
Patient 8      AGAGGTATTTCTTCTCCTTATCGCTTTGTAACTTTTGAACCCTTTAATGTTAGTTTTGTT 2325
               *** ******** ** ******* ***** ******************** *********

Patient 6      AATGACAGTATTGAGTCTGTGGGTGGTCTTTATGAGATCAAAATTCCCACTAACTTTACT 2397
Patient 9      AATGACAGTATTGAGTCTGTGGGTGGTCTTTATGAGATCAAAATTCCCACTAACTTTACT 2397
Patient 10     AATGACAGTATTGAGTCTGTGGGTGGTCTTTATGAGATCAAAATTCCCACTAACTTTACT 2397
Patient 5      AATGACAGTATTGAGTCTGTGGGTGGTCTTTATGAGATCAAAATTCCCACTAACTTTACT 2397
Patient 4      AATGACAGTATTGAGTCTGTGGGTGGTCTTTATGAGATCAAAATTCCCACTAACTTTACT 2397
Patient 7      AATGACAGTATTGAGTCTGTGGGTGGTCTTTATGAGATCAAAATTCCCACTAACTTTACT 2397
Patient 2      AATGACAGTATTGAGTCTGTGGGTGGTCTTTATGAGATCAAAATTCCCACTAACTTTACT 2397
Patient 1      AACGATAGTGTTGAAACTGTTGGTGGTTTATTTGAGATTCAGATTCCTACTAACTTTACC 2385
Patient 8      AACGATAGTGTTGAAACTGTTGGTGGTTTATTTGAGATTCAGATTCCTACTAACTTTACC 2385
               ** ** *** ****  **** ****** * * ******  * ***** *********** 

Patient 6      ATAGTTGGTCAAGAGGAATTTATTCAAACTAATTCTCCTAAAGTTACTATTGATTGTTCT 2457
Patient 9      ATAGTTGGTCAAGAGGAATTTATTCAAACTAATTCTCCTAAAGTTACTATTGATTGTTCT 2457
Patient 10     ATAGTTGGTCAAGAGGAATTTATTCAAACTAATTCTCCTAAAGTTACTATTGATTGTTCT 2457
Patient 5      ATAGTTGGTCAAGAGGAATTTATTCAAACTAATTCTCCTAAAGTTACTATTGATTGTTCT 2457
Patient 4      ATAGTTGGTCAAGAGGAATTTATTCAAACTAATTCTCCTAAAGTTACTATTGATTGTTCT 2457
Patient 7      ATAGTTGGTCAAGAGGAATTTATTCAAACTAATTCTCCTAAAGTTACTATTGATTGTTCT 2457
Patient 2      ATAGTTGGTCAAGAGGAATTTATTCAAACTAATTCTCCTAAAGTTACTATTGATTGTTCT 2457
Patient 1      ATAGCTGGTCATGAAGAATTTATTCAGACTAGTTCTCCTAAAGTTACTATTGATTGTTCA 2445
Patient 8      ATAGCTGGTCATGAAGAATTTATTCAGACTAGTTCTCCTAAAGTTACTATTGATTGTTCA 2445
               **** ****** ** *********** **** ***************************

Patient 6      TTATTTGTCTGTTCTAATTATGCAGCTTGCCATGACTTATTGTCAGAGTATGGCACTTTT 2517
Patient 9      TTATTTGTCTGTTCTAATTATGCAGCTTGCCATGACTTATTGTCAGAGTATGGCACTTTT 2517
Patient 10     TTATTTGTCTGTTCTAATTATGCAGCTTGCCATGACTTATTGTCAGAGTATGGCACTTTT 2517
```

FIG. 13 CONT.

```
Patient 5       TTATTTGTCTGTTCTAATTATGCAGCTTGCCATGACTTATTGTCAGAGTATGGCACTTTT 2517
Patient 4       TTATTTGTCTGTTCTAATTATGCAGCTTGCCATGACTTATTGTCAGAGTATGGCACTTTT 2517
Patient 7       TTATTTGTCTGTTCTAATTATGCAGCTTGCCATGACTTATTGTCAGAGTATGGCACTTTT 2517
Patient 2       TTATTTGTCTGTTCTAATTATGCAGCTTGCCATGACTTATTGTCAGAGTATGGCACTTTT 2517
Patient 1       GCTTTTGTTTGCTCTAATTATGCTGCTTGTCATGATTTATTGTCGGAATATGGCACTTTT 2505
Patient 8       GCTTTTGTTTGCTCTAACTATGCTGCTTGTCATGATTTATTGTCGGAATATGGCACTTTT 2505
                   ***** ** ***** ***** ***** ***** ******** ** ************

Patient 6       TGTGATAATATTAATAGTATTTTAGATGAAGTTAATGGTTTACTTGATACTACTCAATTG 2577
Patient 9       TGTGATAATATTAATAGTATTTTAGATGAAGTTAATGGTTTACTTGATACTACTCAATTG 2577
Patient 10      TGTGATAATATTAATAGTATTTTAGATGAAGTTAATGGTTTACTTGATACTACTCAATTG 2577
Patient 5       TGTGATAATATTAATAGTATTTTAGATGAAGTTAATGGTTTACTTGATACTACTCAATTG 2577
Patient 4       TGTGATAATATTAATAGTATTTTAGATGAAGTTAATGGTTTACTTGATACTACTCAATTG 2577
Patient 7       TGTGATAATATTAATAGTATTTTAGATGAAGTTAATGGTTTACTTGATACTACTCAATTG 2577
Patient 2       TGTGATAATATTAATAGTATTTTAGATGAAGTTAATGGTTTACTTGATACTACTCAATTG 2577
Patient 1       TGCGATAATATTAATAGTATTTTAAATGAAGTCAATGATTTACTTGATATTACTCAGTTG 2565
Patient 8       TGCGATAATATTAATAGTATTTTAAATGAAGTCAATGATTTACTTGATATTACTCAGTTG 2565
                ** ********************* ******* **** *********** ****** ***

Patient 6       CATGTAGCTGATACTCTTATGCAAGGTGTCACACTTAGCTCCAATCTTAATACTAATTTG 2637
Patient 9       CATGTAGCTGATACTCTTATGCAAGGTGTCACACTTAGCTCCAATCTTAATACTAATTTG 2637
Patient 10      CATGTAGCTGATACTCTTATGCAAGGTGTCACACTTAGCTCCAATCTTAATACTAATTTG 2637
Patient 5       CATGTAGCTGATACTCTTATGCAAGGTGTCACACTTAGCTCCAATCTTAATACTAATTTG 2637
Patient 4       CATGTAGCTGATACTCTTATGCAAGGTGTCACACTTAGCTCCAATCTTAATACTAATTTG 2637
Patient 7       CATGTAGCTGATACTCTTATGCAAGGTGTCACACTTAGCTCCAATCTTAATACTAATTTG 2637
Patient 2       CATGTAGCTGATACTCTTATGCAAGGTGTCACACTTAGCTCCAATCTTAATACTAATTTG 2637
Patient 1       CAGGTTGCTAATGCTTTAATGCAAGGTGTTACACTTAGTTCTAATCTTAATACTAATCTA 2625
Patient 8       CAGGTTGCTAATGCTCTAATGCAAGGTGTTACACTTAGTTCTAATCTTAATACTAATCTA 2625
                ** ** *** ** ** * *********** ******** ** *************** *

Patient 6       CATTTTGATGTTGATAATATTAATTTTAAATCCCTAGTTGGATGTTTAGGTCCACACTGC 2697
Patient 9       CATTTTGATGTTGATAATATTAATTTTAAATCCCTAGTTGGATGTTTAGGTCCACACTGC 2697
Patient 10      CATTTTGATGTTGATAATATTAATTTTAAATCCCTAGTTGGATGTTTAGGTCCACACTGC 2697
Patient 5       CATTTTGATGTTGATAATATTAATTTTAAATCCCTAGTTGGATGTTTAGGTCCACACTGC 2697
Patient 4       CATTTTGATGTTGATAATATTAATTTTAAATCCCTAGTTGGATGTTTAGGTCCACACTGC 2697
Patient 7       CATTTTGATGTTGATAATATTAATTTTAAATCCCTAGTTGGATGTTTAGGTCCACACTGC 2697
Patient 2       CATTTTGATGTTGATAATATTAATTTTAAATCCCTAGTTGGATGTTTAGGTCCACACTGC 2697
Patient 1       CACTCTGATGTTGATAATATAGATTTTAAATCTCTTCTAGGTTGTTTAGGTTCACAATGT 2685
Patient 8       CACTCTGATGTTGATAATATAGATTTTAAATCTCTTCTAGGTTGTTTAGGTTCACAATGT 2685
                ** * ***************  ********** **  * ** ********* **** **

Patient 6       GGTTCTTCTTCTCGTTCTTTTTTTGAAGATTTATTGTTTGACAAAGTTAAACTTTCAGAT 2757
Patient 9       GGTTCTTCTTCTCGTTCTTTTTTTGAAGATTTATTGTTTGACAAAGTTAAACTTTCAGAT 2757
Patient 10      GGTTCTTCTTCTCGTTCTTTTTTTGAAGATTTATTGTTTGACAAAGTTAAACTTTCAGAT 2757
Patient 5       GGTTCTTCTTCTCGTTCTTTTTTTGAAGATTTATTGTTTGACAAAGTTAAACTTTCAGAT 2757
Patient 4       GGTTCTTCTTCTCGTTCTTTTTTTGAAGATTTATTGTTTGACAAAGTTAAACTTTCAGAT 2757
Patient 7       GGTTCTTCTTCTCGTTCTTTTTTTGAAGATTTATTGTTTGACAAAGTTAAACTTTCAGAT 2757
Patient 2       GGTTCTTCTTCTCGTTCTTTTTTTGAAGATTTATTGTTTGACAAAGTTAAACTTTCAGAT 2757
Patient 1       GGTTCTTCGTCTAGATCTTTGTTAGAGGATTTATTATTCAACAAGGTCAAACTTTCAGAT 2745
Patient 8       GGTTCTTCGTCTAGATCTTTGTTAGAGGATTTATTATTCAACAAAGTCAAACTTTCAGAT 2745
                ******** *** * ***** ** ** ******** **  **** ** ************

Patient 6       GTTGGTTTTGTTGAAGCTTATAACAATTGTACTGGTGGTAGTGAAATTAGAGATCTTCTT 2817
Patient 9       GTTGGTTTTGTTGAAGCTTATAACAATTGTACTGGTGGTAGTGAAATTAGAGATCTTCTT 2817
Patient 10      GTTGGTTTTGTTGAAGCTTATAACAATTGTACTGGTGGTAGTGAAATTAGAGATCTTCTT 2817
Patient 5       GTTGGTTTTGTTGAAGCTTATAACAATTGTACTGGTGGTAGTGAAATTAGAGATCTTCTT 2817
Patient 4       GTTGGTTTTGTTGAAGCTTATAACAATTGTACTGGTGGTAGTGAAATTAGAGATCTTCTT 2817
Patient 7       GTTGGTTTTGTTGAAGCTTATAACAATTGTACTGGTGGTAGTGAAATTAGAGATCTTCTT 2817
Patient 2       GTTGGTTTTGTTGAAGCTTATAACAATTGTACTGGTGGTAGTGAAATTAGAGATCTTCTT 2817
Patient 1       GTAGGTTTTGTTGAAGCTTATAATAATTGCACTGGTGGTAGTGAAATTAGAGATCTTCTC 2805
Patient 8       GTAGGTTTTGTTGAAGCTTATAATAATTGCACTGGTGGTAGTGAAATTAGAGATCTTCTC 2805
                ** ******************** ***** *****************************

Patient 6       TGTGTACAATCCTTTAATGGTATTAAAGTTTTGCCTCCTATTTTGTCTGAATCTCAAATT 2877
Patient 9       TGTGTACAATCCTTTAATGGTATTAAAGTTTTGCCTCCTATTTTGTCTGAATCTCAAATT 2877
Patient 10      TGTGTACAATCCTTTAATGGTATTAAAGTTTTGCCTCCTATTTTGTCTGAATCTCAAATT 2877
Patient 5       TGTGTACAATCCTTTAATGGTATTAAAGTTTTGCCTCCTATTTTGTCTGAATCTCAAATT 2877
Patient 4       TGTGTACAATCCTTTAATGGTATTAAAGTTTTGCCTCCTATTTTGTCTGAATCTCAAATT 2877
Patient 7       TGTGTACAATCCTTTAATGGTATTAAAGTTTTGCCTCCTATTTTGTCTGAATCTCAAATT 2877
Patient 2       TGTGTACAATCCTTTAATGGTATTAAAGTTTTGCCTCCTATTTTGTCTGAATCTCAAATT 2877
Patient 1       TGTGTGCAATCTTTTAATGGTATTAAAGTATTACCTCCCATTTTATCTGAGACTCAAATT 2865
Patient 8       TGTGTGCAATCTTTTAATGGTATTAAAGTATTACCTCCCATTTTATCTGAGACTCAAATT 2865
                ***** ***** ***************** ** ***** ***** *****  ********

Patient 6       TCTGGTTACACCACAGCCGCTACTGTTGCTGCTATGTTTCCACCATGGTCAGCAGCAGCT 2937
Patient 9       TCTGGTTACACCACAGCCGCTACTGTTGCTGCTATGTTTCCACCATGGTCAGCAGCAGCT 2937
```

FIG. 13 CONT.

```
Patient 10      TCTGGTTACACCACAGCCGCTACTGTTGCTGCTATGTTTCCACCATGGTCAGCAGCAGCT 2937
Patient 5       TCTGGTTACACCACAGCCGCTACTGTTGCTGCTATGTTTCCACCATGGTCAGCAGCAGCT 2937
Patient 4       TCTGGTTACACCACAGCCGCTACTGTTGCTGCTATGTTTCCACCATGGTCAGCAGCAGCT 2937
Patient 7       TCTGGTTACACCACAGCCGCTACTGTTGCTGCTATGTTTCCACCATGGTCAGCAGCAGCT 2937
Patient 2       TCTGGTTACACCACAGCCGCTACTGTTGCTGCTATGTTTCCACCATGGTCAGCAGCAGCT 2937
Patient 1       TCTGGCTATACTACAGCTGCTACTGTGGCGGCTATGTTTCCGCCATGGTCTGCTGCTGCT 2925
Patient 8       TCTGGCTATACTACAGCTGCTACTGTGGCGGCTATGTTTCCGCCATGGTCTGCTGCTGCT 2925
                ***** ** ** ***** ******** ** *********** ******** ** ** ***

Patient 6       GGCATACCATTTTCTCTTAATGTACAATATAGAATTAATGGTTTGGGTGTTACTATGGAT 2997
Patient 9       GGCATACCATTTTCTCTTAATGTACAATATAGAATTAATGGTTTGGGTGTTACTATGGAT 2997
Patient 10      GGCATACCATTTTCTCTTAATGTACAATATAGAATTAATGGTTTGGGTGTTACTATGGAT 2997
Patient 5       GGCATACCATTTTCTCTTAATGTACAATATAGAATTAATGGTTTGGGTGTTACTATGGAT 2997
Patient 4       GGCATACCATTTTCTCTTAATGTACAATATAGAATTAATGGTTTGGGTGTTACTATGGAT 2997
Patient 7       GGCATACCATTTTCTCTTAATGTACAATATAGAATTAATGGTTTGGGTGTTACTATGGAT 2997
Patient 2       GGCATACCATTTTCTCTTAATGTACAATATAGAATTAATGGTTTGGGTGTTACTATGGAT 2997
Patient 1       GGTGTACCATTTTCTCTTAATGTACAATATAGAATTAATGGTTTGGGTGTTACTATGGAT 2985
Patient 8       GGTGTACCATTTTCTCTTAATGTACAATATAGAATTAATGGTTTGGGTGTTACTATGGAT 2985
                **  ********************************************************

Patient 6       GTTCTTAATAAAAATCAAAAGTTGATAGCTACTGCTTTTAATAATGCTCTTCTTTCTATT 3057
Patient 9       GTTCTTAATAAAAATCAAAAGTTGATAGCTACTGCTTTTAATAATGCTCTTCTTTCTATT 3057
Patient 10      GTTCTTAATAAAAATCAAAAGTTGATAGCTACTGCTTTTAATAATGCTCTTCTTTCTATT 3057
Patient 5       GTTCTTAATAAAAATCAAAAGTTGATAGCTACTGCTTTTAATAATGCTCTTCTTTCTATT 3057
Patient 4       GTTCTTAATAAAAATCAAAAGTTGATAGCTACTGCTTTTAATAATGCTCTTCTTTCTATT 3057
Patient 7       GTTCTTAATAAAAATCAAAAGTTGATAGCTACTGCTTTTAATAATGCTCTTCTTTCTATT 3057
Patient 2       GTTCTTAATAAAAATCAAAAGTTGATAGCTACTGCTTTTAATAATGCTCTTCTTTCTATT 3057
Patient 1       GTTCTTAATAAGAATCAAAAGTTAATAGCTAATGCTTTTAATAAAGCTCTTCTTTCTATC 3045
Patient 8       GTTCTTAATAAGAATCAAAAGTTAATAGCTAATGCTTTTAATAAAGCTCTTCTTTCTATC 3045
                *********** *********** ******* ************ ************** 

Patient 6       CAGAATGGTTTTAGTGCTACCAACTCTGCACTTGCTAAAATACAAAGTGTTGTTAATTCT 3117
Patient 9       CAGAATGGTTTTAGTGCTACCAACTCTGCACTTGCTAAAATACAAAGTGTTGTTAATTCT 3117
Patient 10      CAGAATGGTTTTAGTGCTACCAACTCTGCACTTGCTAAAATACAAAGTGTTGTTAATTCT 3117
Patient 5       CAGAATGGTTTTAGTGCTACCAACTCTGCACTTGCTAAAATACAAAGTGTTGTTAATTCT 3117
Patient 4       CAGAATGGTTTTAGTGCTACCAACTCTGCACTTGCTAAAATACAAAGTGTTGTTAATTCT 3117
Patient 7       CAGAATGGTTTTAGTGCTACCAACTCTGCACTTGCTAAAATACAAAGTGTTGTTAATTCT 3117
Patient 2       CAGAATGGTTTTAGTGCTACCAACTCTGCACTTGCTAAAATACAAAGTGTTGTTAATTCT 3117
Patient 1       CAGAATGGTTTTACTGCTACTAACTCTGCTCTTGCTAAAATTCAAAGTGTCGTTAATGCT 3105
Patient 8       CAGAATGGTTTTACTGCTACTAACTCTGCTCTTGCTAAAATTCAAAGTGTCGTTAATGCT 3105
                ************* ****** ******** *********** ******** ****** **

Patient 6       AATGCTCAAGCACTTAATAGTTTGTTACAGCAATTATTTAATAAATTTGGTGCAATTAGT 3177
Patient 9       AATGCTCAAGCACTTAATAGTTTGTTACAGCAATTATTTAATAAATTTGGTGCAATTAGT 3177
Patient 10      AATGCTCAAGCACTTAATAGTTTGTTACAGCAATTATTTAATAAATTTGGTGCAATTAGT 3177
Patient 5       AATGCTCAAGCACTTAATAGTTTGTTACAGCAATTATTTAATAAATTTGGTGCAATTAGT 3177
Patient 4       AATGCTCAAGCACTTAATAGTTTGTTACAGCAATTATTTAATAAATTTGGTGCAATTAGT 3177
Patient 7       AATGCTCAAGCACTTAATAGTTTGTTACAGCAATTATTTAATAAATTTGGTGCAATTAGT 3177
Patient 2       AATGCTCAAGCACTTAATAGTTTGTTACAGCAATTATTTAATAAATTTGGTGCAATTAGT 3177
Patient 1       AATGCTCAAGCACTTAATAGTTTGTTACAACAATTATTTAATAAATTTGGTGCTATTAGT 3165
Patient 8       AATGCTCAAGCACTTAATAGTTTGTTACAACAATTATTTAATAAATTTGGTGCTATTAGT 3165
                ***************************** *********************** ******

Patient 6       TCTTCTTTACAAGAAATTTTATCTCGTCTCGATGCTTTAGAGGCTCAGGTTCAGATTGAT 3237
Patient 9       TCTTCTTTACAAGAAATTTTATCTCGTCTCGATGCTTTAGAGGCTCAGGTTCAGATTGAT 3237
Patient 10      TCTTCTTTACAAGAAATTTTATCTCGTCTCGATGCTTTAGAGGCTCAGGTTCAGATTGAT 3237
Patient 5       TCTTCTTTACAAGAAATTTTATCTCGTCTCGATGCTTTAGAGGCTCAGGTTCAGATTGAT 3237
Patient 4       TCTTCTTTACAAGAAATTTTATCTCGTCTCGATGCTTTAGAGGCTCAGGTTCAGATTGAT 3237
Patient 7       TCTTCTTTACAAGAAATTTTATCTCGTCTCGATGCTTTAGAGGCTCAGGTTCAGATTGAT 3237
Patient 2       TCTTCTTTACAAGAAATTTTATCTCGTCTCGATGTTTTAGAGGCTCAGGTTCAGATTGAT 3237
Patient 1       TCTTCTTTACAAGAAATTTTGTCTCGCCTTGATAATTTAGAAGCTCAGGTTCAGATTGAT 3225
Patient 8       TCTTCTTTACAAGAAATTTTGTCTCGCCTTGATAATTTAGAAGCTCAGGTTCAGATTGAT 3225
                ******************** ***** ** ***  ****** ******************

Patient 6       AGGCTTATTAATGGTCGTTTAACTGCTTTAAATGCTTATGTCTCTCAACAGCTTAGTGAT 3297
Patient 9       AGGCTTATTAATGGTCGTTTAACTGCTTTAAATGCTTATGTCTCTCAACAGCTTAGTGAT 3297
Patient 10      AGGCTTATTAATGGTCGTTTAACTGCTTTAAATGCTTATGTCTCTCAACAGCTTAGTGAT 3297
Patient 5       AGGCTTATTAATGGTCGTTTAACTGCTTTAAATGCTTATGTCTCTCAACAGCTTAGTGAT 3297
Patient 4       AGGCTTATTAATGGTCGTTTAACTGCTTTAAATGCTTATGTCTCTCAACAGCTTAGTGAT 3297
Patient 7       AGGCTTATTAATGGTCGTTTAACTGCTTTAAATGCTTATGTCTCTCAACAGCTTAGTGAT 3297
Patient 2       AGGCTTATTAATGGTCGTTTAACTGCTTTAAATGCTTATGTCTCTCAACAGCTTAGTGAT 3297
Patient 1       AGGCTCATTAATGGTCGTTTGACTGCTTTAAATGCTTATGTTTCTCAACAGCTTAGTGAT 3285
Patient 8       AGGCTCATTAATGGTCGTTTGACTGCTTTAAATGCTTATGTTTCTCAACAGCTTAGTGAT 3285
                ***** ************** ******************** ******************

Patient 6       ATTTCTCTTGTAAAATTTGGTGCTGCTTTAGCTATGGAGAAGGTTAATGAGTGTGTTAAA 3357
```

FIG. 13 CONT.

```
Patient 9     ATTTCTCTTGTAAAATTTGGTGCTGCTTTAGCTATGGAGAAGGTTAATGAGTGTGTTAAA 3357
Patient 10    ATTTCTCTTGTAAAATTTGGTGCTGCTTTAGCTATGGAGAAGGTTAATGAGTGTGTTAAA 3357
Patient 5     ATTTCTCTTGTAAAATTTGGTGCTGCTTTAGCTATGGAGAAGGTTAATGAGTGTGTTAAA 3357
Patient 4     ATTTCTCTTGTAAAATTTGGTGCTGCTTTAGCTATGGAGAAGGTTAATGAGTGTGTTAAA 3357
Patient 7     ATTTCTCTTGTAAAATTTGGTGCTGCTTTAGCTATGGAGAAGGTTAATGAGTGTGTTAAA 3357
Patient 2     ATTTCTCTTGTAAAATTTGGTGCTGCTTTAGCTATGGAGAAGGTTAATGAGTGTGTTAAA 3357
Patient 1     ATTACACTTATTAAGGCTGGAGCTTCTCGTGCTATTGAGAAGGTTAATGAGTGTGTTAAA 3345
Patient 8     ATTACACTTATTAAGGCTGGAGCTTCTCGTGCTATTGAGAAGGTTAATGAGTGTGTTAAA 3345
              *** * *** * **   *** *** **   ***** ************************

Patient 6     AGTCAATCTCCTCGTATTAATTTTTGTGGTAATGGTAATCATATTTTGTCATTAGTTCAA 3417
Patient 9     AGTCAATCTCCTCGTATTAATTTTTGTGGTAATGGTAATCATATTTTGTCATTAGTTCAA 3417
Patient 10    AGTCAATCTCCTCGTATTAATTTTTGTGGTAATGGTAATCATATTTTGTCATTAGTTCAA 3417
Patient 5     AGTCAATCTCCTCGTATTAATTTTTGTGGTAATGGTAATCATATTTTGTCATTAGTTCAA 3417
Patient 4     AGTCAATCTCCTCGTATTAATTTTTGTGGTAATGGTAATCATATTTTGTCATTAGTTCAA 3417
Patient 7     AGTCAATCTCCTCGTATTAATTTTTGTGGTAATGGTAATCATATTTTGTCATTAGTTCAA 3417
Patient 2     AGTCAATCTCCTCGTATTAATTTTTGTGGTAATGGTAATCATATTTTGTCATTAGTTCAA 3417
Patient 1     AGTCAATCCCCTCGTATAAATTTTTGTGGCAATGGTAACCACATTTTATCATTGGTTCAA 3405
Patient 8     AGTCAATCCCCTCGTATAAATTTTTGTGGCAATGGTAACCACATTTTATCATTGGTTCAA 3405
              ******** ******** *********** ******** ** ***** ***** ******

Patient 6     AATGCTCCTTATGGTTTGTTGTTTATGCATTTTAGTTATAAACCTATTTCTTTTAAAACT 3477
Patient 9     AATGCTCCTTATGGTTTGTTGTTTATGCATTTTAGTTATAAACCTATTTCTTTTAAAACT 3477
Patient 10    AATGCTCCTTATGGTTTGTTGTTTATGCATTTTAGTTATAAACCTATTTCTTTTAAAACT 3477
Patient 5     AATGCTCCTTATGGTTTGTTGTTTATGCATTTTAGTTATAAACCTATTTCTTTTAAAACT 3477
Patient 4     AATGCTCCTTATGGTTTGTTGTTTATGCATTTTAGTTATAAACCTATTTCTTTTAAAACT 3477
Patient 7     AATGCTCCTTATGGTTTGTTGTTTATGCATTTTAGTTATAAACCTATTTCTTTTAAAACT 3477
Patient 2     AATGCTCCTTATGGTTTGTTGTTTATGCATTTTAGTTATAAACCTATTTCTTTTAAAACT 3477
Patient 1     AATGCTCCTTATGGTTTGCTTTTCATTCATTTTAGTTATAAACCTACTTCTTTTAAAACT 3465
Patient 8     AATGCTCCTTATGGTTTGCTTTTCATTCATTTTAGTTATAAACCTACTTCTTTTAAAACT 3465
              ****************** * ** ** ******************* *************

Patient 6     GTTTTAGTAAGTCCTGGTTTGTGTATATCAGGTGATGTAGGTATTGCACCTAAACAAGGG 3537
Patient 9     GTTTTAGTAAGTCCTGGTTTGTGTATATCAGGTGATGTAGGTATTGCACCTAAACAAGGG 3537
Patient 10    GTTTTAGTAAGTCCTGGTTTGTGTATATCAGGTGATGTAGGTATTGCACCTAAACAAGGG 3537
Patient 5     GTTTTAGTAAGTCCTGGTTTGTGTATATCAGGTGATGTAGGTATTGCACCTAAACAAGGG 3537
Patient 4     GTTTTAGTAAGTCCTGGTTTGTGTATATCAGGTGATGTAGGTATTGCACCTAAACAAGGG 3537
Patient 7     GTTTTAGTAAGTCCTGGTTTGTGTATATCAGGTGATGTAGGTATTGCACCTAAACAAGGG 3537
Patient 2     GTTTTAGTAAGTCCTGGTTTGTGTATATCAGGTGATGTAGGTATTGCACCTAAACAAGGG 3537
Patient 1     GTCTTAGTAAGTCCAGGTTTATGTTTATCCGGTGATAGAGGTATTGCACCTAAGCAAGGT 3525
Patient 8     GTCTTAGTAAGTCCAGGTTTATGTTTATCCGGTGATAGAGGTATTGCACCTAAGCAAGGT 3525
              ** *********** ***** *** **** ******  *************** *****

Patient 6     TATTTTATTAAACATAATGATCATTGGATGTTCACTGGTAGTTCTTACTATTATCCTGAA 3597
Patient 9     TATTTTATTAAACATAATGATCATTGGATGTTCACTGGTAGTTCTTACTATTATCCTGAA 3597
Patient 10    TATTTTATTAAACATAATGATCATTGGATGTTCACTGGTAGTTCTTACTATTATCCTGAA 3597
Patient 5     TATTTTATTAAACATAATGATCATTGGATGTTCACTGGTAGTTCTTACTATTATCCTGAA 3597
Patient 4     TATTTTATTAAACATAATGATCATTGGATGTTCACTGGTAGTTCTTACTATTATCCTGAA 3597
Patient 7     TATTTTATTAAACATAATGATCATTGGATGTTCACTGGTAGTTCTTACTATTATCCTGAA 3597
Patient 2     TATTTTATTAAACATAATGATCATTGGATGTTCACTGGTAGTTCTTACTATTATCCTGAA 3597
Patient 1     TATTTTATTAAACAAAATGATTCCTGGATGTTTACTGGTAGTTCCTATTATTACCCAGAA 3585
Patient 8     TATTTTATTAAACAAAATGATTCCTGGATGTTTACTGGTAGTTCCTATTATTATCCAGAA 3585
              ************** ******   ******** *********** ** ***** ** ***

Patient 6     CCAATTTCAGATAAAAATGTTGTTTTTATGAATACTTGTTCTGTTAATTTTACTAAAGCG 3657
Patient 9     CCAATTTCAGATAAAAATGTTGTTTTTATGAATACTTGTTCTGTTAATTTTACTAAAGCG 3657
Patient 10    CCAATTTCAGATAAAAATGTTGTTTTTATGAATACTTGTTCTGTTAATTTTACTAAAGCG 3657
Patient 5     CCAATTTCAGATAAAAATGTTGTTTTTATGAATACTTGTTCTGTTAATTTTACTAAAGCG 3657
Patient 4     CCAATTTCAGATAAAAATGTTGTTTTTATGAATACTTGTTCTGTTAATTTTACTAAAGCG 3657
Patient 7     CCAATTTCAGATAAAAATGTTGTTTTTATGAATACTTGTTCTGTTAATTTTACTAAAGCG 3657
Patient 2     CCAATTTCAGATAAAAATGTTGTTTTTATGAATACTTGTTCTGTTAATTTTACTAAAGCG 3657
Patient 1     CCAATTTCAGATAAAAATGTTGTTTTCATGAATAGTTGCTCTGTTAATTTTACTAAAGCT 3645
Patient 8     CCAATTTCAGATAAAAATGTTGTTTTCATGAATAGTTGCTCTGTTAATTTTACTAAAGCT 3645
              ************************** ******* *** ********************

Patient 6     CCTCTTGTTTATTTGAATCATTCTGTACCAAAATTGTCTGATTTTGAATCTGAGTTATCT 3717
Patient 9     CCTCTTGTTTATTTGAATCATTCTGTACCAAAATTGTCTGATTTTGAATCTGAGTTATCT 3717
Patient 10    CCTCTTGTTTATTTGAATCATTCTGTACCAAAATTGTCTGATTTTGAATCTGAGTTATCT 3717
Patient 5     CCTCTTGTTTATTTGAATCATTCTGTACCAAAATTGTCTGATTTTGAATCTGAGTTATCT 3717
Patient 4     CCTCTTGTTTATTTGAATCATTCTGTACCAAAATTGTCTGATTTTGAATCTGAGTTATCT 3717
Patient 7     CCTCTTGTTTATTTGAATCATTCTGTACCAAAATTGTCTGATTTTGAATCTGAGTTATCT 3717
Patient 2     CCTCTTGTTTATTTGAATCATTCTGTACCAAAATTGTCTGATTTTGAATCTGAGTTATCT 3717
Patient 1     CCATTTATTTATCTTAATAATTCTATACCAAATTTGTCTGATTTTGAAGCCGAGTTTTCT 3705
Patient 8     CCATTTATTTATCTTAATAATTCTATACCAAATTTGTCTGATTTTGAAGCCGAGTTATCT 3705
              **  ** ***** * *** ***** ******* *************** * ***** ***
```

FIG. 13 CONT.

```
Patient 6     CATTGGTTTAAAAATCAAACATCCATTGCGCCTAATTTGACTTTAAATCTTCATACTATT 3777
Patient 9     CATTGGTTTAAAAATCAAACATCCATTGCGCCTAATTTGACTTTAAATCTTCATACTATT 3777
Patient 10    CATTGGTTTAAAAATCAAACATCCATTGCGCCTAATTTGACTTTAAATCTTCATACTATT 3777
Patient 5     CATTGGTTTAAAAATCAAACATCCATTGCGCCTAATTTGACTTTAAATCTTCATACTATT 3777
Patient 4     CATTGGTTTAAAAATCAAACATCCATTGCGCCTAATTTGACTTTAAATCTTCATACTATT 3777
Patient 7     CATTGGTTTAAAAATCAAACATCCATTGCGCCTAATTTGACTTTAAATCTTCATACTATT 3777
Patient 2     CATTGGTTTAAAAATCAAACATCCATTGCGCCTAATTTGACTTTAAATCTTCATACTATT 3777
Patient 1     CTTTGGTTTAAAAATCATACTTCTATAGCACCTAATTTAACCTTTAATTCTCATA---TT 3762
Patient 8     CTTTGGTTTAAAAATCATACTTCTATAGCACCTAATTTAACCTTTAATTCTCATA---TT 3762
              * *************** ** ** ** ** ******** ** ** ***  *****   **

Patient 6     AATGCTACTTTTTTAGATTTGTATTATGAGATGAATCTTATTCAAGAGTCTATTAAGTCT 3837
Patient 9     AATGCTACTTTTTTAGATTTGTATTATGAGATGAATCTTATTCAAGAGTCTATTAAGTCT 3837
Patient 10    AATGCTACTTTTTTAGATTTGTATTATGAGATGAATCTTATTCAAGAGTCTATTAAGTCT 3837
Patient 5     AATGCTACTTTTTTAGATTTGTATTATGAGATGAATCTTATTCAAGAGTCTATTAAGTCT 3837
Patient 4     AATGCTACTTTTTTAGATTTGTATTATGAGATGAATCTTATTCAAGAGTCTATTAAGTCT 3837
Patient 7     AATGCTACTTTTTTAGATTTGTATTATGAGATGAATCTTATTCAAGAGTCTATTAAGTCT 3837
Patient 2     AATGCTACTTTTTTAGATTTGTATTATGAGATGAATCTTATTCAAGAGTCTATTAAGTCT 3837
Patient 1     AATGCTACTTTTTTAGATCTGTATTATGAAATGAATGTTATTCAGGAATCTATTAAATCT 3822
Patient 8     AATGCTACTTTTTTAGATCTGTATTATGAAATGAATGTTATTCAGGAATCTATTAAATCT 3822
              ****************** ********** ****** ******* ** ******** ***

Patient 6     TTGAATAATAGTTATATCAATCTTAAAGATATAGGTACATATGAAATGTATGTAAAATGG 3897
Patient 9     TTGAATAATAGTTATATCAATCTTAAAGATATAGGTACATATGAAATGTATGTAAAATGG 3897
Patient 10    TTGAATAATAGTTATATCAATCTTAAAGATATAGGTACATATGAAATGTATGTAAAATGG 3897
Patient 5     TTGAATAATAGTTATATCAATCTTAAAGATATAGGTACATATGAAATGTATGTAAAATGG 3897
Patient 4     TTGAATAATAGTTATATCAATCTTAAAGATATAGGTACATATGAAATGTATGTAAAATGG 3897
Patient 7     TTGAATAATAGTTATATCAATCTTAAAGATATAGGTACATATGAAATGTATGTAAAATGG 3897
Patient 2     TTGAATAATAGTTATATCAATCTTAAAGATATAGGTACATATGAAATGTATGTAAAATGG 3897
Patient 1     TTGAACAGTAGTTTTATTAATCTTAAAGAAATAGGTACTTATGAAATGTATGTTAAATGG 3882
Patient 8     TTGAACAGTAGTTTTATTAATCTTAAAGAAATAGGTACTTATGAAATGTATGTTAAATGG 3882
              ***** * ***** *** *********** ******** ************** ******

Patient 6     CCTTGGTATGTTTGGCTACTAATTTCTTTTTCATTTATAATATTCCTTGTATTGCTCTTT 3957
Patient 9     CCTTGGTATGTTTGGCTACTAATTTCTTTTTCATTTATAATATTCCTTGTATTGCTCTTT 3957
Patient 10    CCTTGGTATGTTTGGCTACTAATTTCTTTTTCATTTATAATATTCCTTGTATTGCTCTTT 3957
Patient 5     CCTTGGTATGTTTGGCTACTAATTTCTTTTTCATTTATAATATTCCTTGTATTGCTCTTT 3957
Patient 4     CCTTGGTATGTTTGGCTACTAATTTCTTTTTCATTTATAATATTCCTTGTATTGCTCTTT 3957
Patient 7     CCTTGGTATGTTTGGCTACTAATTTCTTTTTCATTTATAATATTCCTTGTATTGCTCTTT 3957
Patient 2     CCTTGGTATGTTTGGCTACTAATTTCTTTTTCATTTATAATATTCCTTGTATTGCTCTTT 3957
Patient 1     CCTTGGTACATTTGGTTGTTAATTGTCATTTTATTTATAATTTTTCTTATGATACTTTTC 3942
Patient 8     CCTTGGTACATTTGGTTGTTAATTGTCATTTTATTTATAATTTTTCTTATGATACTTTTC 3942
              ********  ***** *  *****    *** ********* ** *** *  * ** **

Patient 6     TTTATATGTTGTTGTACTGGTTGTGGTTCTGCATGTTTTAGTAAATGTCATAATTGTTGT 4017
Patient 9     TTTATATGTTGTTGTACTGGTTGTGGTTCTGCATGTTTTAGTAAATGTCATAATTGTTGT 4017
Patient 10    TTTATATGTTGTTGTACTGGTTGTGGTTCTGCATGTTTTAGTAAATGTCATAATTGTTGT 4017
Patient 5     TTTATATGTTGTTGTACTGGTTGTGGTTCTGCATGTTTTAGTAAATGTCATAATTGTTGT 4017
Patient 4     TTTATATGTTGTTGTACTGGTTGTGGTTCTGCATGTTTTAGTAAATGTCATAATTGTTGT 4017
Patient 7     TTTATATGTTGTTGTACTGGTTGTGGTTCTGCATGTTTTAGTAAATGTCATAATTGTTGT 4017
Patient 2     TTTATATGTTGTTGTACTGGTTGTGGTTCTGCATGTTTTAGTAAATGTCATAATTGTTGT 4017
Patient 1     TTTATATGCTGCTGTACTGGTTGTGGTTCAGCATGTTTTAGTAAATGTCATAATTGTTGT 4002
Patient 8     TTTATATGCTGCTGTACTGGTTGTGGTTCAGCATGTTTTAGTAAATGTCATAATTGTTGT 4002
              ******** ** ***************** ******************************

Patient 6     GATGAGTATGGTGGTCATCATGATTTTGTTATCAAAACATCTCATGATGATTAG 4071
Patient 9     GATGAGTATGGTGGTCATCATGATTTTGTTATCAAAACATCTCATGATGATTAG 4071
Patient 10    GATGAGTATGGTGGTCATCATGATTTTGTTATCAAAACATCTCATGATGATTAG 4071
Patient 5     GATGAGTATGGTGGTCATCATGATTTTGTTATCAAAACATCTCATGATGATTAG 4071
Patient 4     GATGAGTATGGTGGTCATCATGATTTTGTTATCAAAACATCTCATGATGATTAG 4071
Patient 7     GATGAGTATGGTGGTCATCATGATTTTGTTATCAAAACATCTCATGATGATTAG 4071
Patient 2     GATGAGTATGGTGGTCATCATGATTTTGTTATCAAAACATCTCATGATGATTAG 4071
Patient 1     GATGAGTATGGGGGTCACAATGATTTTGTTATTAAAGCATCTCATGATGATTAG 4056
Patient 8     GATGAGTATGGGGGTCACAATGATTTTGTTATTAAAGCATCTCATGATGATTAG 4056
              *********** ***** ************** *** *****************
```

FIG. 13 CONT.

Fig. 14. Multiple alignment of the nucleocapsid genes of CoV-HKU1 from patients 1, 2, 4, 5, 6, 7, 8, 9, and 10.

```
Patient 4       ATGTCTTATACTCCCGGTCATTATGCTGGAAGTAGAAGCTCCTCTGGAAATCGTTCAGGA 60
Patient 6       ATGTCTTATACTCCCGGTCATTATGCTGGAAGTAGAAGCTCCTCTGGAAATCGTTCAGGA 60
Patient 7       ATGTCTTATACTCCCGGTCATTATGCTGGAAGTAGAAGCTCCTCTGGAAATCGTTCAGGA 60
Patient 9       ATGTCTTATACTCCCGGTCATTATGCTGGAAGTAGAAGCTCCTCTGGAAATCGTTCAGGA 60
Patient 10      ATGTCTTATACTCCCGGTCATTATGCTGGAAGTAGAAGCTCCTCTGGAAATCGTTCAGGA 60
Patient 2       ATGTCTTATACTCCCGGTCATTATGCTGGAAGTAGAAGCTCCTCTGGAAATCGTTCAGGA 60
Patient 5       ATGTCTTATACTCCCGGTCATTATGCTGGAAGTAGAAGCTCCTCTGGAAATCGTTCAGGA 60
Patient 1       ATGTCTTATACTCCCGGTCATCATGCTGGAAGTAGAAGCTCCTCTGGAAATCGTTCAGGA 60
Patient 8       ATGTCTTATACTCCCGGTCATCATGCTGGAAGTAGAAGCTCCTCTGGAAATCGTTCAGGA 60
                ********************* **************************************

Patient 4       ATCCTCAAGAAAACTTCTTGGGCTGACCAATCTGAACGAAATTACCAAACCTTTAATAGA 120
Patient 6       ATCCTCAAGAAAACTTCTTGGGCTGACCAATCTGAACGAAATTACCAAACCTTTAATAGA 120
Patient 7       ATCCTCAAGAAAACTTCTTGGGCTGACCAATCTGAACGAAATTACCAAACCTTTAATAGA 120
Patient 9       ATCCTCAAGAAAACTTCTTGGGCTGACCAATCTGAACGAAATTACCAAACCTTTAATAGA 120
Patient 10      ATCCTCAAGAAAACTTCTTGGGCTGACCAATCTGAACGAAATTACCAAACCTTTAATAGA 120
Patient 2       ATCCTCAAGAAAACTTCTTGGGCTGACCAATCTGAGCGAAATTACCAAACCTTTAATAGA 120
Patient 5       ATCCTCAAGAAAACTTCTTGGGCTGACCAATCTGAGCGAAATTACCAAACCTTTAATAGA 120
Patient 1       ATCCTCAAGAAAACTTCTTGGGTTGACCAATCTGAGCGAAGCCATCAAACCTATAATAGA 120
Patient 8       ATCCTCAAGAAAACTTCTTGGGTTGACCAATCTGAGCGAAGCCATCAAACCTATAATAGA 120
                ********************** ************ ****   * ******* *******

Patient 4       GGCAGAAAAACCCAACCTAAATTCACTGTGTCTACTCAACCACAAGGAAATACTATCCCA 180
Patient 6       GGCAGAAAAACCCAACCTAAATTCACTGTGTCTACTCAACCACAAGGAAATACTATCCCA 180
Patient 7       GGCAGAAAAACCCAACCTAAATTCACTGTGTCTACTCAACCACAAGGAAATACTATCCCA 180
Patient 9       GGCAGAAAAACCCAACCTAAATTCACTGTGTCTACTCAACCACAAGGAAATACTATCCCA 180
Patient 10      GGCAGAAAAACCCAACCTAAATTCACTGTGTCTACTCAACCACAAGGAAATACTATCCCA 180
Patient 2       GGCAGAAAAACCCAACCTAAATTCACTGTGTCTACTCAACCACAAGGAAATACTATCCCA 180
Patient 5       GGCAGAAAAACCCAACCTAAATTCACTGTGTCTACTCAACCACAAGGAAATACTATCCCA 180
Patient 1       GGCAGAAAACCCCAACCCAAATTCACTGTGTCTACTCAACCACAAGGAAACCCTATCCCA 180
Patient 8       GGCAGAAAACCCCAACCAAAATTCACTGTGTCTACTCAACCACAAGGAAACCCTATCCCA 180
                ********* ******* ********************************  ********

Patient 4       CATTATTCCTGGTTCTCCGGGATCACTCAATTTCAAAAAGGTAGAGACTTTAAATTTTCA 240
Patient 6       CATTATTCCTGGTTCTCCGGGATCACTCAATTTCAAAAAGGTAGAGACTTTAAATTTTCA 240
Patient 7       CATTATTCCTGGTTCTCCGGGATCACTCAATTTCAAAAAGGTAGAGACTTTAAATTTTCA 240
Patient 9       CATTATTCCTGGTTCTCCGGGATCACTCAATTTCAAAAAGGTAGAGACTTTAAATTTTCA 240
Patient 10      CATTATTCCTGGTTCTCCGGGATCACTCAATTTCAAAAAGGTAGAGACTTTAAATTTTCA 240
Patient 2       CATTATTCCTGGTTCTCCGGGATCACTCAATTTCAAAAAGGTAGAGACTTTAAATTTTCA 240
Patient 5       CATTATTCCTGGTTCTCCGGGATCACTCAATTTCAAAAAGGTAGAGACTTTAAATTTTCA 240
Patient 1       CATTATTCCTGGTTCTCTGGGATTACCCAATTTCAAAAAGGTAGAGACTTTAAATTTCCA 240
Patient 8       CATTATTCCTGGTTCTCTGGGATTACCCAATTTCAAAAAGGTAGAGACTTTAAATTTCCA 240
                ***************** ***** ** ****************************** **

Patient 4       GATGGTCAAGGAGTTCCCATTGCTTTCGGAGTACCCCCTTCTGAAGCAAAAGGATATTGG 300
Patient 6       GATGGTCAAGGAGTTCCCATTGCTTTCGGAGTACCCCCTTCTGAAGCAAAAGGATATTGG 300
Patient 7       GATGGTCAAGGAGTTCCCATTGCTTTCGGAGTACCCCCTTCTGAAGCAAAAGGATATTGG 300
Patient 9       GATGGTCAAGGAGTTCCCATTGCTTTCGGAGTACCCCCTTCTGAAGCAAAAGGATATTGG 300
Patient 10      GATGGTCAAGGAGTTCCCATTGCTTTCGGAGTACCCCCTTCTGAAGCAAAAGGATATTGG 300
Patient 2       GATGGTCAAGGAGTTCCCATTGCTTTCGGAGTACCCCCTTCTGAAGCAAAAGGATATTGG 300
Patient 5       GATGGTCAAGGAGTTCCCATTGCTTTCGGAGTACCCCCTTCTGAAGCAAAAGGATATTGG 300
Patient 1       GATGGTCAAGGAGTACCCATTGCTTACGGGATACCCCCTTCTGAAGCAAAAGGATATTGG 300
Patient 8       GATGGTCAAGGAGTACCCATTGCTTACGGGATACCCCCTTCTGAAGCAAAAGGATATTGG 300
                ************** ********** ***  *****************************

Patient 4       TATAGACACAGCCGGCGTTCTTTTAAAACAGCTGATGGTCAACAAAAGCAGTTGTTACCG 360
Patient 6       TATAGACACAGCCGGCGTTCTTTTAAAACAGCTGATGGTCAACAAAAGCAGTTGTTACCG 360
Patient 7       TATAGACACAGCCGGCGTTCTTTTAAAACAGCTGATGGTCAACAAAAGCAGTTGTTACCG 360
Patient 9       TATAGACACAACCGGCGTTCTTTTAAAACAGCTGATGGTCAACAAAAGCAGTTGTTACCG 360
Patient 10      TATAGACACAGCCGGCGTTCTTTTAAAACAGCTGATGGTCAACAAAAGCAGTTGTTACCG 360
Patient 2       TATAGACACAGCCGGCGTTCTTTTAAAACAGCTGATGGTCAACAAAAGCAGTTGTTACCG 360
Patient 5       TATAGACACAGCCGGCGTTCTTTTAAAACAGCTGATGGTCAACAAAAGCAGTTGTTACCG 360
Patient 1       TATAAACACAACCGGCGTTCTTTTAAAACAGCTGATGGTCAACAAAAGCAGTTGTTACCA 360
Patient 8       TATAAACACAACCGGCGTTCTTTTAAAACAGCTGATGGTCAACAAAAGCAGTTGTTACCA 360
                **** ***** ************************************************ 

Patient 4       AGATGGTATTTCTACTATCTCGGTACCGGCCCATATGCCAATGCATCCTATGGTGAATCC 420
Patient 6       AGATGGTATTTCTACTATCTCGGTACCGGCCCATATGCCAATGCATCCTATGGTGAATCC 420
Patient 7       AGATGGTATTTCTACTATCTCGGTACCGGCCCATATGCCAATGCATCCTATGGTGAATCC 420
Patient 9       AGATGGTATTTCTACTATCTCGGTACCGGCCCATATGCCAATGCATCCTATGGTGAATCC 420
Patient 10      AGATGGTATTTCTACTATCTCGGTACCGGCCCATATGCCAATGCATCCTATGGTGAATCC 420
Patient 2       AGATGGTATTTCTACTATCTCGGTACCGGCCCATATGCCAATGCATCCTATGGTGAATCC 420
Patient 5       AGATGGTATTTCTACTATCTCGGTACCGGCCCATATGCCAATGCATCCTATGGTGAATCC 420
Patient 1       AGATGGTATTTCTACTATCTCGGTACCGGTCCATATGCCAGTTCATCCTATGGTGATGCC 420
```

FIG. 14

```
Patient 8     AGATGGTATTTCTACTATCTCGGTACCGGTCCATATGCCAGTTCATCCTATGGTGATGCC 420
              ***************************** ********** * *************  **

Patient 4     CTCGAAGGGGTCTTCTGGGTTGCTAATCACCAAGCTGACACTTCTACTCCCTCCGATGTT 480
Patient 6     CTCGAAGGGGTCTTCTGGGTTGCTAATCACCAAGCTGACACTTCTACTCCCTCCGATGTT 480
Patient 7     CTCGAAGGGGTCTTCTGGGTTGCTAATCACCAAGCTGACACTTCTACTCCCTCCGATGTT 480
Patient 9     CTCGAAGGGGTCTTCTGGGTTGCTAATCACCAAGCTGACACTTCTACTCCCTCCGATGTT 480
Patient 10    CTCGAAGGGGTCTTCTGGGTTGCTAATCACCAAGCTGACACTTCTACTCCCTCCGATGTT 480
Patient 2     CTCGAAGGGGTCTTCTGGGTTGCTAATCACCAAGCTGACACTTCTACTCCCTCCGATGTT 480
Patient 5     CTCGAAGGGGTCTTCTGGGTTGCTAATCACCAAGCTGACACTTCTACTCCCTCCGATGTT 480
Patient 1     CACGAAGGTATCTTCTGGGTCGCTAGTCACCAAGCTGACACTTCTATTCCCTCCGATGTT 480
Patient 8     CACGAAGGTATCTTCTGGGTCGCTAGTCACCAAGCTGATACTTCTATTCCCTCCGATGTT 480
              * ******  ********** **** ************ ******* *************

Patient 4     TCGTCAAGGGATCCTACTACTCAAGAAGCTATCCCTACTAGGTTTCCGCCTGGTACGATT 540
Patient 6     TCGTCAAGGGATCCTACTACTCAAGAAGCTATCCCTACTAGGTTTCCGCCTGGTACGATT 540
Patient 7     TCGTCAAGGGATCCTACTACTCAAGAAGCTATCCCTACTAGGTTTCCGCCTGGTACGATT 540
Patient 9     TCGTCAAGGGATCCTACTACTCAAGAAGCTATCCCTACTAGGTTTCCGCCTGGTACGATT 540
Patient 10    TCGTCAAGGGATCCTACTACTCAAGAAGCTATCCCTACTAGGTTTCCGCCTGGTACGATT 540
Patient 2     TCGTCAAGGGATCCTACTACTCAAGAAGCTATCCCTACTAGGTTTCCGCCTGGTACGATT 540
Patient 5     TCGTCAAGGGATCCTACTACTCAAGAAGCTATCCCTACTAGGTTTCCGCCTGGTACGATT 540
Patient 1     TCGGCAAGGGATCCTACTATTCAAGAAGCTATCCCTACTAGGTTTTCGCCTGGTACGATT 540
Patient 8     TCGGCAAGGGATCCTACTATTCAAGAAGCTATCCCTACTAGGTTTTCGCCTGGTACGATT 540
              *** *************** ************************* **************

Patient 4     TTGCCTCAAGGCTATTATGTTGAAGGCTCAGGAAGGTCTGCTTCTAATAGTCGACCAGGT 600
Patient 6     TTGCCTCAAGGCTATTATGTTGAAGGCTCAGGAAGGTCTGCTTCTAATAGTCGACCAGGT 600
Patient 7     TTGCCTCAAGGCTATTATGTTGAAGGCTCAGGAAGGTCTGCTTCTAATAGTCGACCAGGT 600
Patient 9     TTGCCTCAAGGCTATTATGTTGAAGGCTCAGGAAGGTCTGCTTCTAATAGTCGACCAGGT 600
Patient 10    TTGCCTCAAGGCTATTATGTTGAAGGCTCAGGAAGGTCTGCTTCTAATAGTCGACCAGGT 600
Patient 2     TTGCCTCAAGGCTATTATGTTGAAGGCTCAGGAAGGTCTGCTTCTAATAGTCGACCAGGT 600
Patient 5     TTGCCTCAAGGCTATTATGTTGAAGGCTCAGGAAGGTCTGCTTCTAATAGTCGACCAGGT 600
Patient 1     TTGCCTCAAGGCTATTATGTTGAAGGCTCAGGAAGGTCTGCTTCTAATAGCCGGCCAGGT 600
Patient 8     TTGCCTCAAGGCTATTATGTTGAAGGCTCAGGAAGGTCTGCTTCTAATAGCCGGCCAGGT 600
              ************************************************** ** ******

Patient 4     TCACGTTCTCAATCACGTGGACCCAATAATCGTTCATTAAGTAGAAGTAATTCTAATTTT 660
Patient 6     TCACGTTCTCAATCACGTGGACCCAATAATCGTTCATTAAGTAGAAGTAATTCTAATTTT 660
Patient 7     TCACGTTCTCAATCACGTGGACCCAATAATCGTTCATTAAGTAGAAGTAATTCTAATTTT 660
Patient 9     TCACGTTCTCAATCACGTGGACCCAATAATCGTTCATTAAGTAGAAGTAATTCCAATTTT 660
Patient 10    TCACGTTCTCAATCACGTGGACCCAATAATCGTTCATTAAGTAGAAGTAATTCTAATTTT 660
Patient 2     TCACGTTCTCAATCACGTGGACCCAATAATCGTTCATTAAGTAGAAGTAATTCTAATTTT 660
Patient 5     TCACGTTCTCAATCACGTGGACCCAATAATCGTTCATTAAGTAGAAGTAATTCTAATTTT 660
Patient 1     TCACGTTCTCAATCACGTGGACCCAATAATCGTTCATTAAGTAGAAGTAATTCTAATTTT 660
Patient 8     TCACGTTCTCAATCACGTGGACCCAATAATCGTTCATTAAGTAGAAGTAATTCTAATTTT 660
              ***************************************************** ******

Patient 4     AGACATTCAGATTCTATAGTAAAACCTGATATGGCTGATGAGATTGCTAATCTTGTTTTA 720
Patient 6     AGACATTCAGATTCTATAGTAAAACCTGATATGGCTGATGAGATTGCTAATCTTGTTTTA 720
Patient 7     AGACATTCAGATTCTATAGTAAAACCTGATATGGCTGATGAGATTGCTAATCTTGTTTTA 720
Patient 9     AGACATTCAGATTCTATAGTAAAACCTGATATGGCTGATGAGATTGCTAATCTTGTTTTA 720
Patient 10    AGACATTCAGATTCTATAGTAAAACCTGATATGGCTGATGAGATTGCTAATCTTGTTTTA 720
Patient 2     AGACATTCAGATTCTATAGTAAAACCTGATATGGCTGATGAGATCGCTAATCTTGTTTTA 720
Patient 5     AGACATTCAGATTCTATAGTAAAACCTGATATGGCTGATGAGATCGCTAATCTTGTTTTA 720
Patient 1     AGACATTCTGATTCTATAGTGAAACCTGATATGGCTGATGAGATTGCTAGTCTTGTCTTG 720
Patient 8     AGACATTCTGATTCTATAGTGAAACCTGATATGGCTGATGAGATTGCTAGTCTTGTCTTA 720
              ******** *********** *********************** **** ****** **

Patient 4     GCCAAGCTTGGTAAAGAATCTAAACCTCAGCAAGTCACTAAGCAAAATGCCAAGGAAATT 780
Patient 6     GCCAAGCTTGGTAAAGAATCTAAACCTCAGCAAGTCACTAAGCAAAATGCCAAGGAAATT 780
Patient 7     GCCAAGCTTGGTAAAGAATCTAAACCTCAGCAAGTCACTAAGCAAAATGCCAAGGAAATT 780
Patient 9     GCCAAGCTTGGTAAAGAATCTAAACCTCAGCAAGTCACTAAGCAAAATGCCAAGGAAATT 780
Patient 10    GCCAAGCTTGGTAAAGAATCTAAACCTCAGCAAGTCACTAAGCAAAATGCCAAGGAAATT 780
Patient 2     GCCAAGCTTGGTAAAGATTCTAAACCTCAGCAAGTCACTAAGCAAAATGCCAAGGAAATC 780
Patient 5     GCCAAGCTTGGTAAAGATTCTAAACCTCAGCAAGTCACTAAGCAAAATGCCAAGGAAATC 780
Patient 1     GCCAAGCTTGGTAAAGATTCTAAACCTCAGCAAGTTACCAAGCAAAATGCTAAGGAAATT 780
Patient 8     GCCAAGCTTGGTAAAGATTCTAAACCTCAGCAAGTTACCAAGCAAAATGCTAAGGAAATT 780
              ***************** ***************** ** *********** ********

Patient 4     AGGCATAAAATTTTAACAAAACCTCGCCAAAAGCGAACTCCTAATAAACATTGTAATGTT 840
Patient 6     AGGCATAAAATTTTAACAAAACCTCGCCAAAAGCGAACTCCTAATAAACATTGTAATGTT 840
Patient 7     AGGCATAAAATTTTAACAAAACCTCGCCAAAAGCGAACTCCTAATAAACATTGTAATGTT 840
Patient 9     AGGCATAAAATTTTAACAAAACCTCGCCAAAAGCGAACTCCTAATAAACATTGTAATGTT 840
Patient 10    AGGCATAAAATTTTAACAAAACCTCGCCAAAAGCGAACTCCTAATAAACATTGTAATGTT 840
Patient 2     AGGCATAAAATTTTAACAAAACCTCGCCAAAAGCGAACTCCTAATAAACATTGTAATGTT 840
Patient 5     AGGCATAAAATTTTAACAAAACCTCGCCAAAAGCGAACTCCTAATAAACATTGTAATGTT 840
```

FIG. 14 CONT.

```
Patient 1     AGGCATAAAATTTTAATGAAACCTCGCCAAAAGCGAACTCCTAATAAATTTTGTAATGTT 840
Patient 8     AGGCATAAAATTTTAATGAAACCTCGCCAAAAGCGAACTCCTAATAAATTTTGTAATGTT 840
              ****************  ******************************  **********

Patient 4     CAACAGTGTTTTGGTAAAAGAGGACCTTCTCAAAATTTTGGTAATGCTGAAATGTTAAAG 900
Patient 6     CAACAGTGTTTTGGTAAAAGAGGACCTTCTCAAAATTTTGGTAATGCTGAAATGTTAAAG 900
Patient 7     CAACAGTGTTTTGGTAAAAGAGGACCTTCTCAAAATTTTGGTAATGCTGAAATGTTAAAG 900
Patient 9     CAACAGTGTTTTGGTAAAAGAGGACCTTCTCAAAATTTTGGTAATGCTGAAATGTTAAAG 900
Patient 10    CAACAGTGTTTTGGTAAAAGAGGACCTTCTCAAAATTTTGGTAATGCTGAAATGTTAAAG 900
Patient 2     CAACAGTGTTTTGGTAAAAGAGGACCTTCTCAAAATTTTGGTAATGCTGAAATGTTAAAG 900
Patient 5     CAACAGTGTTTTGGTAAAAGAGGACCTTCTCAAAATTTTGGTAATGCTGAAATGTTAAAG 900
Patient 1     CAACAGTGTTTTGGTAAAAGAGGACCGCTCCAAAACTTTGGTAATTCTGAAATGTTAAAG 900
Patient 8     CAACAGTGTTTTGGTAAAAGAGGACCGCTCCAAAACTTTGGTAATTCTGAAATGTTAAAG 900
              **************************    ***** ********* **************

Patient 4     CTTGGTACTAATGATCCTCAGTTTCCTATTCTTGCAGAATTAGCTCCTACACCAGGTGCT 960
Patient 6     CTTGGTACTAATGATCCTCAGTTTCCTATTCTTGCAGAATTAGCTCCTACACCAGGTGCT 960
Patient 7     CTTGGTACTAATGATCCTCAGTTTCCTATTCTTGCAGAATTAGCTCCTACACCAGGTGCT 960
Patient 9     CTTGGTACTAATGATCCTCAGTTTCCTATTCTTGCAGAATTAGCTCCTACACCAGGTGCT 960
Patient 10    CTTGGTACTAATGATCCTCAGTTTCCTATTCTTGCAGAATTAGCTCCTACACCAGGTGCT 960
Patient 2     CTTGGTACTAATGATCCTCAGTTTCCTATTCTTGCAGAATTAGCTCCTACACCAGGTGCT 960
Patient 5     CTTGGTACTAATGATCCTCAGTTTCCTATTCTTGCAGAATTAGCTCCTACACCAGGTGCT 960
Patient 1     CTTGGTACTAATGATCCTCAATTTCCTATTCTTGCTGAATTAGCCCCTACACCAGGTGCT 960
Patient 8     CTTGGTACTAATGATCCTCAATTTCCTATTCTTGCTGAATTAGCTCCTACACCAGGTGCT 960
              ******************** ************** ******** ***************

Patient 4     TTTTTCTTTGGTTCTAAATTAGACTTGGTTAAAAGAGATTCCGAGGCTGACTCACCTGTT 1020
Patient 6     TTTTTCTTTGGTTCTAAATTAGACTTGGTTAAAAGAGATTCCGAGGCTGACTCACCTGTT 1020
Patient 7     TTTTTCTTTGGTTCTAAATTAGACTTGGTTAAAAGAGATTCCGAGGCTGACTCACCTGTT 1020
Patient 9     TTTTTCTTTGGTTCTAAATTAGACTTGGTTAAAAGAGATTCCGAGGCTGACTCACCTGTT 1020
Patient 10    TTTTTCTTTGGTTCTAAATTAGACTTGGTTAAAAGAGATTCCGAGGCTGACTCACCTGTT 1020
Patient 2     TTTTTCTTTGGTTCTAAATTAGACTTGGTTAAAAGAGATTCCGAGGCTGACTCACCTGTT 1020
Patient 5     TTTTTCTTTGGTTCTAAATTAGACTTGGTTAAAAGAGATTCCGAGGCTGACTCACCTGTT 1020
Patient 1     TTTTTCTTTGGCTCTAAATTAGAGTTGTTTAAAAGAGACTCTGATGCTGATTCACCTTCT 1020
Patient 8     TTTTTCTTTGGCTCTAAATTAGAGTTGTTTAAAAGAGACTCTGATGCTGATTCACCTTCT 1020
              *********** *********** *** ********** ** ** ***** ******  *

Patient 4     AAAGATGTTTTTGAACTTCATTATTCTGGTTCTATTAGGTTTGATAGTACTTTACCAGGC 1080
Patient 6     AAAGATGTTTTTGAACTTCATTATTCTGGTTCTATTAGGTTTGATAGTACTTTACCAGGC 1080
Patient 7     AAAGATGTTTTTGAACTTCATTATTCTGGTTCTATTAGGTTTGATAGTACTTTACCAGGC 1080
Patient 9     AAAGATGTTTTTGAACTTCATTATTCTGGTTCTATTAGGTTTGATAGTACTTTACCAGGC 1080
Patient 10    AAAGATGTTTTTGAACTTCATTATTCTGGTTCTATTAGGTTTGATAGTACTTTACCAGGC 1080
Patient 2     AAAGATGTTTTTGAACTTCATTATTCTGGTTCTATTAGGTTTGATAGTACTTTACCAGGC 1080
Patient 5     AAAGATGTTTTTGAACTTCATTATTCTGGTTCTATTAGGTTTGATAGTACTTTACCAGGC 1080
Patient 1     AAAGACACTTTTGAACTTCGTTATTCTGGTTCTATTAGGTTTGATAGTACTTTACCTGGT 1080
Patient 8     AAAGACACTTTTGAACTTCGTTATTCTGGTTCTATTAGGTTTGATAGTACTTTACCTGGT 1080
              *****   *********** ************************************ ** 

Patient 4     TTTGAGACAATTATGAAAGTTCTTGAAGAGAATTTAAATGCTTATGTTAATTCTAATCAG 1140
Patient 6     TTTGAGACAATTATGAAAGTTCTTGAAGAGAATTTAAATGCTTATGTTAATTCTAATCAG 1140
Patient 7     TTTGAGACAATTATGAAAGTTCTTGAAGAGAATTTAAATGCTTATGTTAATTCTAATCAG 1140
Patient 9     TTTGAGACAATTATGAAAGTTCTTGAAGAGAACTTAAATGCTTATGTTAATTCTAATCAG 1140
Patient 10    TTTGAGACAATTATGAAAGTTCTTGAAGAGAACTTAAATGCTTATGTTAATTCTAATCAG 1140
Patient 2     TTTGAGACAATTATGAAAGTTCTTGAAGAGAATTTAAATGCTTACGTTAATTCTAATCAG 1140
Patient 5     TTTGAGACAATTATGAAAGTTCTTGAAGAGAATTTAAATGCTTACGTTAATTCTAATCAG 1140
Patient 1     TTTGAGACAATTATGAAAGTTCTTAAAGAGAATTTAGATGCTTATGTTAATTCTAATCAG 1140
Patient 8     TTTGAGACAATTATGAAAGTTCTTAAAGAGAATTTAGATGCTTATGTTAATTCTAATCAG 1140
              ************************ ******* *** ******* ***************

Patient 4     AACACTGATTCTGATTCGTTGAGTTCTAAACCTCAGCGTAAAAGAGGTGTTAAACAATTA 1200
Patient 6     AACACTGATTCTGATTCGTTGAGTTCTAAACCTCAGCGTAAAAGAGGTGTTAAACAATTA 1200
Patient 7     AACACTGATTCTGATTCGTTGAGTTCTAAACCTCAGCGTAAAAGAGGTGTTAAACAATTA 1200
Patient 9     AACACTGATTCTGATTCGTTGAGTTCTAAACCTCAGCGTAAAAGAGGTGTTAAACAATTA 1200
Patient 10    AACACTGATTCTGATTCGTTGAGTTCTAAACCTCAGCGTAAAAGAGGTGTTAAACAATTA 1200
Patient 2     AACACTGATTCTGATTCGTTGAGTTCTAAACCTCAGCGTAAAAGAGGTGTTAAACAATTA 1200
Patient 5     AACACTGATTCTGATTCGTTGAGTTCTAAACCTCAGCGTAAAAGAGGTGTTAAACAATTA 1200
Patient 1     AACACTGTTTCTGGTTCGCTGAGTCCTAAACCTCAGCGTAAAAGAGGTGTTAAACAATCA 1200
Patient 8     AACACTGTTTCTGGTTCGCTGAGTCCTAAACCTCAGCGTAAAAGAGGTGTTAAACAATCA 1200
              ******* ***** **** ***** ********************************* *

Patient 4     CCAGAACAGTTTGACTCTCTTAATTTAAGTGCTGGTACTCAGCACATTTCAAATGATTTT 1260
Patient 6     CCAGAACAGTTTGACTCTCTTAATTTAAGTGCTGGTACTCAGCACATTTCAAATGATTTT 1260
Patient 7     CCAGAACAGTTTGACTCTCTTAATTTAAGTGCTGGTACTCAGCACATTTCAAATGATTTT 1260
Patient 9     CCAGAACAGTTTGACTCTCTTAATTTAAGTGCTGGTACTCAGCACATTTCAAATGATTTT 1260
Patient 10    CCAGAACAGTTTGACTCTCTTAATTTAAGTGCTGGTACTCAGCACATTTCAAATGATTTT 1260
Patient 2     CCAGAACAGTTTGACTCTCTTAATTTAAGTGCTGGTACTCAGCACATTTCAAATGATTTT 1260
```

FIG. 14 CONT.

```
Patient 5     CCAGAACAGTTTGACTCTCTTAATTTAAGTGCTGGTACTCAGCACATTTCAAATGATTTT 1260
Patient 1     CCTGAATCGTTTGACTCTCTTAATTTAAGTGCTGATACTCAGCACATTTCAAATGATTTT 1260
Patient 8     CCTGAATCGTTTGACTCTCTTAATTTAAGTGCTGATACTCAGCACATTTCAAATGATTTT 1260
              ** ***  ************************* **************************

Patient 4     ACTCCTGAGGATCATAGTTTACTTGCTACTCTTGACGATCCTTATGTAGAAGACTCTGTT 1320
Patient 6     ACTCCTGAGGATCATAGTTTACTTGCTACTCTTGACGATCCTTATGTAGAAGACTCTGTT 1320
Patient 7     ACTCCTGAGGATCATAGTTTACTTGCTACTCTTGACGATCCTTATGTAGAAGACTCTGTT 1320
Patient 9     ACTCCTGAGGATCATAGTTTACTTGCTACTCTTGACGATCCTTATGTAGAAGACTCTGTT 1320
Patient 10    ACTCCTGAGGATCATAGTTTACTTGCTACTCTTGACGATCCTTATGTAGAAGACTCTGTT 1320
Patient 2     ACTCCTGAGGATCATAGTTTACTTGCTACTCTTGATGATCCTTATGTAGAAGACTCTGTT 1320
Patient 5     ACTCCTGAGGATCATAGTTTACTTGCTACTCTTGATGATCCTTATGTAGAAGACTCTGTT 1320
Patient 1     ACTCCTGAGGATCATAGTTTACTTGCTACTCTTGATGATYCTTATGTAGAAGACTCTGTT 1320
Patient 8     ACTCCTGAGGATCATAGTTTACTTGCTACTCTTGATGATCCTTATGTAGAAGACTCTGTT 1320
              *********************************** *** ********************

Patient 4     GCTTAA 1326
Patient 6     GCTTAA 1326
Patient 7     GCTTAA 1326
Patient 9     GCTTAA 1326
Patient 10    GCTTAA 1326
Patient 2     GCTTAA 1326
Patient 5     GCTTAA 1326
Patient 1     GCTTAA 1326
Patient 8     GCTTAA 1326
              ******
```

FIG. 14 CONT.

| | | LPW1926 | | LPW1927 | |
|---|---|---|---|---|---|
| .CoV-HKU1 | (Patient 1) | AAAGGATGTTGACAACCCTGTT | CTTATGGG/…/ATTTTTA | TGTAAGCATTTTAGTATGATGAT | 2258 |
| .CoV-HKU1 | (Patient 2) | AAAGGATGTTGACAACCCTGTT | CTTATGGG/…/ATTTTTA | TGTAAGCATTTTAGTATGATGAT | 2258 |
| .CoV-HKU1 | (Patient 4) | AAAGGATGTTGACAACCCTGTT | CTTATGGG/…/ATTTTTA | TGTAAGCATTTTAGTATGATGAT | 2258 |
| .CoV-HKU1 | (Patient 5) | AAAGGATGTTGACAACCCTGTT | CTTATGGG/…/ATTTTTA | TGTAAGCATTTTAGTATGATGAT | 2258 |
| .CoV-HKU1 | (Patient 6) | AAAGGATGTTGACAACCCTGTT | CTTATGGG/…/ATTTTTA | TGTAAGCATTTTAGTATGATGAT | 2258 |
| .CoV-HKU1 | (Patient 7) | AAAGGATGTTGACAACCCTGTT | CTTATGGG/…/ATTTTTA | TGTAAGCATTTTAGTATGATGAT | 2258 |
| .CoV-HKU1 | (Patient 8) | AAAGGATGTTGACAACCCTGTT | CTTATGGG/…/ATTTTTA | TGTAAGCATTTTAGTATGATGAT | 2258 |
| .CoV-HKU1 | (Patient 9) | AAAGGATGTTGACAACCCTGTT | CTTATGGG/…/ATTTTTA | TGTAAGCATTTTAGTATGATGAT | 2258 |
| .CoV-HKU1 | (Patient 10) | AAAGGATGTTGACAACCCTGTT | CTTATGGG/…/ATTTTTA | TGTAAGCATTTTAGTATGATGAT | 2258 |
| HCoV-OC43 | (NC_005147) | TAAAGATGTTGACAATCCTGTA | CTTATGGG/…/ATTTTTA | AATAAGCATTTTAGTATGATGAT | 2258 |
| SARS-CoV | (NC_004718) | CAGTGATGTAGAAACTCCACAC | CTTATGGG/…/TTACCTG | CGTAAACATTTCTCCATGATGAT | 2270 |
| HCoV-229E | (NC_002645) | GGCCGATGTTGATGATCCTAAA | TTGATGGG/…/TTATTTG | CAAAAGCATTTTTCTATGATGAT | 2255 |
| HCoV-NL63 | (NC_005831) | TGATGGTGTTGAAAACCCTATG | CTTATGGG/…/TTATCTT | AGGAAACATTTTTCAATGATGAT | 2255 |

FIG. 16

HUMAN VIRUS CAUSING RESPIRATORY TRACT INFECTION AND USES THEREOF

This is a continuation-in-part application of U.S. patent application Ser. No. 10/895,064 filed Jul. 21, 2004, which is incorporated by reference in its entirety.

SEQUENCE LISTING

The instant application contains a "lengthy" Sequence Listing which has been submitted via CD-R in lieu of a printed paper copy, and is hereby incorporated by reference in its entirety. Said CD-R, recorded on Mar. 21, 2005, are labeled "CRF", "Copy 1" and "Copy 2", respectively, and each contains only one identical 2.84 MB file (V0690044.APP).

1. INTRODUCTION

The present invention relates to a novel virus causing respiratory tract infection in humans ["coronavirus-HKU1 (CoV-HKU1)"]. Phylogenetic analysis has revealed that the CoV-HKU1 is a new group 2 coronavirus, which has, at least, two (2) genotypes, A and B. The present invention relates to nucleotide sequences comprising the complete genomic sequences of the CoV-HKU1. The invention further relates to nucleotide sequences comprising a portion of the genomic sequences of the CoV-HKU1. The invention also relates to the deduced amino acid sequences of the complete genomes of the CoV-HKU1. The invention further relates to the nucleic acids and peptides encoded by and/or derived from these sequences and their use in diagnostic methods and therapeutic methods, such as for immunogens. The invention further encompasses chimeric or recombinant viruses encoded by said nucleotide sequences and antibodies directed against polypeptides encoded by the nucleotide sequence. Furthermore, the invention relates to vaccine preparations comprising the CoV-HKU1 recombinant and chimeric forms of said virus as well as protein extracts and subunits of said virus.

2. BACKGROUND OF THE INVENTION

Since no microbiological cause has been identified in a significant proportion of patients with respiratory tract infections (Macfarlane, J. T. et al., 1993, Prospective study of aetiology and outcome of adult lower-respiratory-tract infections in the community, *Lancet* 341:511-514; Ruiz, M., S. et al., 1990, Etiology of community-acquired pneumonia: impact of age, comorbidity, and severity, *Am. J. Respir. Crit. Care Med.* 160:397-405), research has been conducted to identify possible novel agent(s). Of the three novel agents identified in the recent three years, including human metapneumovirus (Van den Hoogen, et al., 2001, A newly discovered human pneumovirus isolated from young children with respiratory tract disease, *Nat. Med.* 7:719-724), Severe Acute Respiratory Syndrome (SARS) coronavirus (SARS-CoV) (Peiris, J. S. et al., 2003, Coronavirus as a possible cause of severe acute respiratory syndrome, *Lancet* 361:1319-1325) and human coronavirus NL63 (HCoV-NL63) (Fouchier, R. A. et al., 2004, A previously undescribed coronavirus associated with respiratory disease in humans, *Proc. Natl. Acad. Sci. USA*. 101:6212-6216; van der Hoek, et al., 2004, Identification of a new human coronavirus, *Nat. Med*. 10:368-373), two were coronaviruses. Coronaviruses possess the largest genome of about 30 kb among all RNA viruses. As a result of the unique mechanism of viral replication, coronaviruses have a high frequency of recombination.

Based on genotypic and serological characterization, coronaviruses were divided into three distinct groups, with human coronavirus 229E (HCoV-229E) being a group 1 coronavirus and HCoV-OC43 a group 2 coronavirus (Lai, M. M. et al., 1997, The molecular biology of coronaviruses, *Adv. Virus Res*. 48:1-100). They account for 5-30% of human respiratory tract infections. In late 2002 and 2003, the epidemic caused by SARS-CoV affected over 8000 people with 750 deaths (for example, Peiris, J. S. et al., 2003, Clinical progression and viral load in a community outbreak of coronavirus-associated SARS pneumonia: a prospective study, *Lancet* 361:1767-1772). We have also reported the isolation of SARS-CoV-like viruses from Himalayan palm civets, which suggested that animals could be the reservoir for the ancestor of SARS-CoV (Guan, Y. et al., 2003, Isolation and characterization of viruses related to the SARS coronavirus from animals in southern China, *Science* 302:276-278). On the basis of genome analysis, SARS-CoV belongs to a fourth group of coronavirus, or alternatively, a distant relative of group 2 coronaviruses (Eickmann, M. et al., 2003, Phylogeny of the SARS coronavirus, *Science* 302:1504-1505; Marra, M. A. et al., 2003, The Genome sequence of the SARS-associated coronavirus, *Science* 300:1399-1404; Rota, P. A. et al., 2003, Characterization of a novel coronavirus associated with severe acute respiratory syndrome, *Science* 300:1394-1399; Snijder, E. J. et al., 2003, Unique and conserved features of genome and proteome of SARS-coronavirus, an early split-off from the coronavirus group 2 lineage, *J. Mol. Biol*. 331:991-1004; Yeh, S. H. et al., 2004, Characterization of severe acute respiratory syndrome coronavirus genomes in Taiwan: molecular epidemiology and genome evolution, *Proc. Natl. Acad. Sci. USA*. 101:2542-2547). Recently, a novel group 1 human coronavirus associated with respiratory tract infections, HCoV-NL63, has been discovered, and its genome sequenced (37).

In January, 2004, a 71-year-old Chinese man was admitted to hospital because of fever and chills for two days associated with sore throat, rhinorrhoea, productive cough with purulent sputum, headache and nausea. He had history of pulmonary tuberculosis more than 40 years ago complicated by cicatrization of right upper lobe and bronchiectasis with chronic *Pseudomonas aeruginosa* colonization of airways. He was a chronic smoker and also had chronic obstructive airway disease, hyperlipidemia, and asymptomatic abdominal aortic aneurysm. He had just returned from Shenzhen of China three days before admission. During his three-day trip to Shenzhen, he had no history of contact with or consumption of wild animals. On admission, his oral temperature was 37.6° C. Physical examination showed tracheal deviation to the right and inspiratory crackles over the anterior left lower zone. His haemoglobin level was 14.7 g/dL, total white cell count $12.1\times10^9$/L, with neutrophil $9.7\times10^9$/L, lymphocyte $1.6\times10^9$/L and monocyte $0.5\times10^9$/L, and plate count $303\times10^9$/L. His liver and renal function tests were within normal limits. Chest radiograph showed right upper lobe collapse and new patchy infiltrates over the left lower zone. Blood culture was performed. Empirical oral amoxicillin/clavulanate and azithromycin were commenced. Nasopharyngeal aspirates for direct antigen detection for respiratory viruses, RT-PCR for influenza A virus, human metapneumovirus and SARS-CoV, and viral cultures were negative. Sputum for bacterial culture only recovered *P. aeruginosa*. Sputum for mycobacterial culture was negative.

Blood culture was negative. Paired sera for antibodies against *Mycoplasma, Chlamydia, Legionella*, and SARS-CoV did not show any rise in antibody titres. His fever subsided two days after admission. His cough improved and he was discharged after five days of hospitalization. Amoxicillin/clavulanate and azithromycin were continued for a total of seven days. The present inventors were the group involved in the investigation of this patient. All tests for identifying commonly recognized viruses and bacteria were negative in these patients. The etiologic agent responsible for this disease was not known until the complete genome of CoV-HKU1 from this patient by the present inventors as disclosed herein. Further studies disclosed herein have revealed that CoV-HKU1 is a human coronavirus and there are, at least, two (2) genotypes, A and B, within CoV-HKU1. The invention is useful in both clinical and scientific research applications.

3. SUMMARY OF INVENTION

The present invention is based upon the inventor's complete genome sequencing of a novel virus ("CoV-HKU1") causing pneumonia in humans. The virus was first discovered from a patient suffering from pneumonia in Hong Kong. The virus is a single-stranded RNA virus of positive polarity which belongs to the order, Nidovirales, of the family, Coronaviridae. Further studies based on prospectively collected nasopharyngeal aspirates (NPAs) from patients with community-acquired pneumonia during a 12-month period, have revealed that there are, at least, two (2) genotypes for CoV-HKU1. Accordingly, the invention relates to CoV-HKU1 that phylogenetically relates to known members of Coronaviridae and specifically belongs to group 2 coronavirus. In a specific embodiment, the invention provides complete genomic sequences of two (2) genotypes of CoV-HKU1. In a preferred embodiment, the virus comprises a nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966. In another specific embodiment, the invention provides nucleic acids isolated from the virus. The virus preferably comprises a nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, in its genome. In a specific embodiment, the present invention provides isolated nucleic acid molecules comprising or, alternatively, consisting of the nucleotide sequence of SEQ ID NO:1, 2920, 2922, 2924, 2926, 2928, 2930, 2932, or 2934, a complement thereof or a portion thereof, preferably at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 1,250, 1,300, 1,350, 1,400, 1,450, 1,500, 1,550, 1,600, 1,650, 1,700, 1,750, 1,800, 1,850, 1,900, 1,950, 2,000, 2,100, 2,200, 2,300, 2,400, 2,500, 2,600, 2,700, or more contiguous nucleotides of the nucleotide sequence of SEQ ID NO:1, 2920, 2922, 2924, 2926, 2928, 2930, 2932, or 2934, or a complement thereof. In another specific embodiment, the present invention provides isolated nucleic acid molecules comprising or, alternatively, consisting of the nucleotide sequence of SEQ ID NO:3 or 2919, a complement thereof or a portion thereof, preferably at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:3, or 2919, or a complement thereof. In yet another specific embodiment, the present invention provides isolated nucleic acid molecules comprising or, alternatively, consisting of the nucleotide sequence of SEQ ID NO:2936, 2938, 2940, 2942, 2944, 2946, 2948, or 2950, a complement thereof, or a portion thereof, preferably at least 5, 10, 15, 20, 25, 30, 35, 40, 45, 100, 150, 200, 250, 300, 350, 400, 450, 500, 550, 600, 650, 700, 750, 800, 850, 900, 950, 1000, 1,050, 1,100, 1,150, 1,200, 1,250, 1,300, 1,350, 1,400, 1,450, 1,500, 1,550, 1,600, 1,650, 1,700, 1,750, 1,800, 1,850, 1,900, 1,950, 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900, 4,000, or more contiguous nucleotides of the nucleotide sequence of SEQ ID NO:2936, 2938, 2940, 2942, 2944, 2946, 2948, or 2950, or a complement thereof. In yet another specific embodiment, the present invention provides isolated nucleic acid molecules comprising or, alternatively, consisting of the nucleotide sequence of SEQ ID NO:2952, 2954, 2956, 2958, 2960, 2962, 2964, or 2966, a complement thereof, or a portion thereof, preferably at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 1,250, 1,300, or more contiguous nucleotides of the nucleotide sequence of SEQ ID NO:2952, 2954, 2956, 2958, 2960, 2962, 2964, or 2966, or a complement thereof. Furthermore, in another specific embodiment, the invention provides isolated nucleic acid molecules which hybridize under stringent conditions, as defined herein, to a nucleic acid molecule having the sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a complement thereof. In preferred embodiments, such nucleic acid molecules encode amino acid sequences that have biological activities exhibited by the polypeptides encoded by the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966. In another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 1,250, 1,300, 1,350, 1,400, 1,450, 1,500, 1,550, 1,600, 1,650, 1,700, 1,750, 1,800, 1,850, 1,900, 1,950, 2,000, 2,100, 2,200, 2,300, 2,400, 2,500, 2,600, 2,700, or more contiguous nucleotides of the nucleotide sequence of SEQ ID NO:1, 2920, 2922, 2924, 2926, 2928, 2930, 2932, or 2934, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 1,250, 1,300, 1,350, 1,400, 1,450, 1,500, 1,550, 1,600, 1,650, 1,700, 1,750, 1,800, 1,850, 1,900, 1,950, 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900, 4,000, or more contiguous nucleotides of the nucleotide sequence of SEQ ID NO:2936, 2938, 2940, 2942, 2944, 2946, 2948, or 2950, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 1,250, 1,300, or more contiguous nucleotides of the nucleotide sequence of SEQ ID NO:2952, 2954, 2956, 2958, 2960, 2962, 2964, or 2966, a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:3 or 2919, or a complement thereof. The polypeptides or proteins include those having the amino acid sequences of SEQ ID NO:2, 34-2918 shown in FIGS. 2 and 3, and SEQ ID NOS:2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and 2970-4236 shown in FIG. 9. The invention further provides proteins or polypeptides that are isolated from the CoV-HKU1, including viral proteins isolated from cells infected with the virus but not present in comparable uninfected cells. The polypeptides or the proteins of the present invention preferably have a biological activity of the protein (including antigenicity and/or immunogenicity) encoded by the nucleotide sequence that is at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 1,250, 1,300, 1,350, 1,400, 1,450, 1,500, 1,550, 1,600, 1,650, 1,700, 1,750, 1,800, 1,850, 1,900, 1,950, 2,000, 2,100, 2,200, 2,300, 2,400, 2,500, 2,600, 2,700, or more contiguous nucleotides of the nucleotide sequence of SEQ ID NO:1, 2920, 2922, 2924, 2926, 2928, 2930, 2932, or 2934. In another embodiment, the polypeptides or the proteins of the present invention have a biological activity of the protein (including antigenicity and/or immunogenicity) encoded by a nucleotide sequence that is at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 1,250, 1,300, 1,350, 1,400, 1,450, 1,500, 1,550, 1,600, 1,650, 1,700, 1,750, 1,800, 1,850, 1,900, 1,950, 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900, 4,000, or more contiguous nucleotides of the nucleotide sequence of SEQ ID NO:2936, 2938, 2940, 2942, 2944, 2946, 2948, or 2950, or a complement thereof. Furthermore, in another embodiment, the polypeptides or the proteins of the present invention have a biological activity of the protein (including antigenicity and/or immunogenicity) encoded by a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 1,250, 1,300, or more contiguous nucleotides of the nucleotide sequence of SEQ ID NO:2952, 2954, 2956, 2958, 2960, 2962, 2964, or 2966, or a complement thereof. In other embodiments, the polypeptides or the proteins of the present invention have a biological activity of the protein (including antigenicity and/or immunogenicity) encoded by a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:3 or 2919, or a complement thereof.

In one aspect, the invention relates to the use of CoV-HKU1 for diagnostic methods. In a specific embodiment, the invention provides a method of detecting in a biological sample an antibody that immunospecifically binds to the CoV-HKU1, or any proteins or polypeptides thereof. In another specific embodiment, the invention provides a method of detecting in a biological sample an antibody that immunospecifically binds to the CoV-HKU1-infected cells. In yet another specific embodiment, the invention provides a method of screening for an antibody that immunospecifically binds and neutralizes CoV-HKU1. Such an antibody is useful for a passive immunization or immunotherapy of a subject infected with CoV-HKU1.

The invention further relates to the use of the sequence information of the isolated virus for diagnostic methods. In a specific embodiment, the invention provides nucleic acid molecules which are suitable for use as primers consisting of or comprising the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, a complement thereof, or at least a portion of the nucleotide sequence thereof. In another specific embodiment, the invention provides nucleic acid molecules which are suitable for hybridization to CoV-HKU1 nucleic acid, including, but not limited to, as PCR primers, Reverse Transcriptase primers, probes for Southern or Northern analysis or other nucleic acid hybridization analysis for the detection of CoV-HKU1 nucleic acids, e.g., consisting of or comprising the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, a complement thereof, or a portion thereof.

The invention further provides antibodies that specifically bind a polypeptide of the invention encoded by the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a fragment thereof, including the polypeptide having the amino acid sequence of SEQ ID NO:2 or any one of SEQ ID NOS:34-2918 shown in FIGS. 2 and 3, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and 2970-4236 shown in FIG. 9, or encoded by a nucleic acid comprising a nucleotide sequence that hybridizes under stringent conditions to the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, and/or any CoV-HKU1 epitope, having one or more biological activities of a polypeptide of the invention. The invention further provides antibodies that specifically bind cells or tissues that are infected by CoV-HKU1. Such antibodies include, but are not limited to polyclonal, monoclonal, bi-specific, multi-specific, human, humanized, chimeric antibodies, single chain antibodies, Fab fragments, F(ab')$_2$ fragments, disulfide-linked Fvs, intrabodies and fragments containing either a VL or VH domain or even a complementary determining region (CDR) that specifically binds to a polypeptide of the invention.

In one embodiment, the invention provides methods for detecting the presence, activity or expression of the CoV-HKU1 of the invention in a biological material, such as cells, blood, saliva, urine, and so forth. The increased or decreased activity or expression of the CoV-HKU1 in a sample relative to a control sample can be determined by contacting the biological material with an agent which can detect directly or indirectly the presence, activity or expression of the CoV-HKU1. In a specific embodiment, the detecting agents are the antibodies or nucleic acid molecules of the present invention. Antibodies of the invention may also be used to detect and/or treat other coronaviruses, such as Severe Acute Respiratory Syndrome ("SARS") viruses.

In another embodiment, the invention provides vaccine preparations, comprising the CoV-HKU1 recombinant and chimeric forms of said virus, or protein subunits of the virus. In a specific embodiment, the present invention provides methods of preparing recombinant or chimeric forms of CoV-HKU1. In another specific invention, the vaccine preparations of the present invention comprise a nucleic acid or fragment of the CoV-HKU1, or nucleic acid molecules having the sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a fragment thereof. In another embodiment, the invention provides vaccine preparations comprising one or more polypeptides isolated from or produced from nucleic acid of CoV-HKU1. In a specific embodiment, the vaccine preparations comprise a polypeptide of the invention encoded by the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a fragment thereof, including the polypeptides having the amino acid sequences of SEQ ID NO:2 or any one of SEQ ID NOS:34-2918, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and 2970-4236. Furthermore, the present invention provides methods for treating, ameliorating, managing or preventing respiratory tract infections caused by CoV-HKU1 by administering to a subject in need thereof the anti-viral agents of the present invention, alone or in combination with various anti-viral agents as well as adjuvants, and/or other pharmaceutically acceptable excipients.

In another aspect, the present invention provides methods for preventing or inhibiting, under a physiological condition, binding to a host cell, or infection of a host cell, or replication in a host cell, of CoV-HKU1 or a virus comprising a nucleic acid molecule comprising the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a complement thereof, by administering to the host cell the anti-viral agents of the present invention, alone or in combination with other anti-viral agents. In a specific embodiment, the anti-viral agent of the invention includes the immunogenic preparations of the invention or an antibody that immunospecifically binds CoV-HKU1 or any CoV-HKU1 epitope and/or neutralizes CoV-HKU1. In another specific embodiment, the anti-viral agent is a polypeptide or protein of the present invention or a nucleic acid molecule of the invention. In a specific embodiment, the host cell is a mammalian cell, including a cell of human, primates, cows, horses, sheep, pigs, fowl (e.g., chickens), goats, cats, dogs, hamsters, mice and rats. Preferably a host cell is a primate cell, and most preferably a human cell. Furthermore, the present invention provides pharmaceutical compositions comprising anti-viral agents of the present invention and a pharmaceutically acceptable carrier. The invention also provides kits containing a pharmaceutical composition of the present invention.

3.1 Definitions

The term "an antibody or an antibody fragment that immunospecifically binds a polypeptide of the invention" as used herein refers to an antibody or a fragment thereof that immunospecifically binds to the polypeptide encoded by the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a fragment thereof, and does not non-specifically bind to other polypeptides. An antibody or a fragment thereof that immunospecifically binds to the polypeptide of the invention may cross-react with other antigens. Preferably, an antibody or a fragment thereof that immunospecifically binds to a polypeptide of the invention does not cross-react with other antigens. An antibody or a fragment thereof that immunospecifically binds to the polypeptide of the invention, can be identified by, for example, immunoassays or other techniques known to those skilled in the art.

An "isolated" or "purified" peptide or protein is substantially free of cellular material or other contaminating proteins from the cell or tissue source from which the protein is derived, or substantially free of chemical precursors or other chemicals when chemically synthesized. The language "substantially free of cellular material" includes preparations of a polypeptide/protein in which the polypeptide/protein is separated from cellular components of the cells from which it is isolated or recombinantly produced. Thus, a polypeptide/protein that is substantially free of cellular material includes preparations of the polypeptide/protein having less than about 30%, 20%, 10%, 5%, 2.5%, or 1%, (by dry weight) of contaminating protein. When the polypeptide/protein is recombinantly produced, it is also preferably substantially free of culture medium, i.e., culture medium represents less than about 20%, 10%, or 5% of the volume of the protein preparation. When polypeptide/protein is produced by chemical synthesis, it is preferably substantially free of chemical precursors or other chemicals, i.e., it is separated from chemical precursors or other chemicals which are involved in the synthesis of the protein. Accordingly, such preparations of the polypeptide/protein have less than about 30%, 20%, 10%, 5% (by dry weight) of chemical precursors or compounds other than polypeptide/protein fragment of interest. In a preferred embodiment of the present invention, polypeptides/proteins are isolated or purified.

An "isolated" nucleic acid molecule is one which is separated from other nucleic acid molecules which are present in the natural source of the nucleic acid molecule. Moreover, an "isolated" nucleic acid molecule, such as a cDNA molecule, can be substantially free of other cellular material, or culture medium when produced by recombinant techniques, or substantially free of chemical precursors or other chemicals when chemically synthesized. In a preferred embodiment of the invention, nucleic acid molecules encoding polypeptides/proteins of the invention are isolated or purified. The term "isolated" nucleic acid molecule does not include a nucleic acid that is a member of a library that has not been purified away from other library clones containing other nucleic acid molecules.

The term "portion" or "fragment" as used herein refers to a fragment of a nucleic acid molecule containing at least about 10, 15, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 1,250, 1,300, 1,350, 1,500, 2,000, 2,500, 3,000, 3,500, 4,000, 4,500, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000, or more contiguous nucleic acids in length of the relevant nucleic acid molecule and having at least one functional feature of the nucleic acid molecule (or the encoded protein has one functional feature of the protein encoded by the nucleic acid molecule); or a fragment of a protein or a polypeptide containing at least 5, 10, 15, 20, 25, 30, 35, 40, 45, 50, 55, 60, 65, 70, 75, 80, 90, 100, 120, 140, 160, 180, 200, 220, 240, 260, 280, 300, 320, 340, 360, 380, 400, 500, 600, 700, 800, 900, 1,000, 1,500, 2,000, 2,500, 3,000, 3,500, 4,000, 4,100, 4,200, 4,300, 4,350, 4,360, 4,370, 4,380 amino acid residues in length of the relevant protein or polypeptide and having at least one functional feature of the protein or polypeptide.

The term "having a biological activity of the protein" or "having biological activities of the polypeptides of the invention" refers to the characteristics of the polypeptides or proteins having a common biological activity similar or identical structural domain and/or having sufficient amino acid identity to the polypeptide encoded by the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or the polypeptide having any one of the amino acid sequences of SEQ ID NOS:2, 34-2918, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and 2970-4236, or a complement thereof. Such common biological activities of the polypeptides of the invention include antigenicity and immunogenicity.

The term "under stringent condition" refers to hybridization and washing conditions under which nucleotide sequences having at least 70%, at least 75%, at least 80%, at least 85%, at least 90%, or at least 95% identity to each other remain hybridized to each other. Such hybridization conditions are described in, for example but not limited to, Current Protocols in Molecular Biology, John Wiley & Sons, N.Y. (1989), 6.3.1-6.3.6.; Basic Methods in Molecular Biology, Elsevier Science Publishing Co., Inc., N.Y. (1986), pp. 75-78, and 84-87; and Molecular Cloning, Cold Spring Harbor Laboratory, N.Y. (1982), pp. 387-389, and are well known to those skilled in the art. A preferred, non-limiting example of stringent hybridization conditions is hybridization in 6× sodium chloride/sodium citrate (SSC), 0.5% SDS at about 68° C. followed by one or more washes (e.g., about 5 to 30 min each) in 2×SSC, 0.5% SDS at room temperature. Another preferred, non-limiting example of stringent hybridization conditions is hybridization in 6×SSC at about 45° C. followed by one or more washes (e.g., about 5 to 30 min each) in 0.2×SSC, 0.1% SDS at about 45-65° C.

The term "variant" as used herein refers either to a naturally occurring genetic mutant of CoV-HKU1 or a recombinantly prepared variation of CoV-HKU1 each of which contain one or more mutations in its genome compared to CoV-HKU1. The term "variant" may also refers either to a naturally occurring variation of a given peptide or a recombinantly prepared variation of a given peptide or protein in which one or more amino acid residues have been modified by amino acid substitution, addition, or deletion.

4. BRIEF DESCRIPTION OF FIGURES

FIG. 1 shows a partial DNA sequence (SEQ ID NO:1) and its deduced amino acid sequence (SEQ ID NO:2) obtained from CoV-HKU1 that has 91% amino acid identity to the RNA-dependent RNA polymerase protein of known *Coronaviruses.*

FIG. 2 shows the entire genomic DNA sequence (SEQ ID NO:3) of the first isolate of CoV-HKU1 and its deduced amino acid sequences therefrom in three frames. An asterisk (*) indicates a stop codon which marks the end of a peptide. The first-frame translation and amino acid sequences: SEQ ID NOS:34-456; the second-frame translation and amino acid sequences: SEQ ID NOS:457-723; and the third-frame translation and amino acid sequences: SEQ ID NOS:724-1318.

FIG. 3 shows the complement (SEQ ID NO:1319) of the entire genomic DNA sequence (SEQ ID NO:3) of CoV-HKU1 in 3'→5' orientation and its deduced amino acid sequences therefrom in three frames. An asterisk (*) indicates a stop codon which marks the end of a peptide. The first-frame translation and amino acid sequences: SEQ ID NOS:1319-1907; the second-frame translation and amino acid sequences: SEQ ID NO:1908-2453; and the third-frame translation and amino acid sequences: SEQ ID NOS:2454-2918.

FIG. 4 shows genome organization of CoV-HKU1. Overall organization of the 29926-nucleotide CoV-HKU1 genomic RNA. Predicted ORFs 1a and 1b, encoding the nonstructural polyproteins (p28, p65 and nsp1-13) and those encoding the hemagglutinin-esterase, spike, envelope, membrane and nucleocapsid structural proteins are indicated. Arrows indicate putative cleavage sites (with the corresponding nucleotide positions) of the replicase polyprotein encoded by ORF 1a and ORF 1b. ATR, PL1$^{pro}$ and PL2$^{pro}$ represent the acidic tandem repeat and the two papain-like proteases, respectively, in nsp1.

Figure 5A:
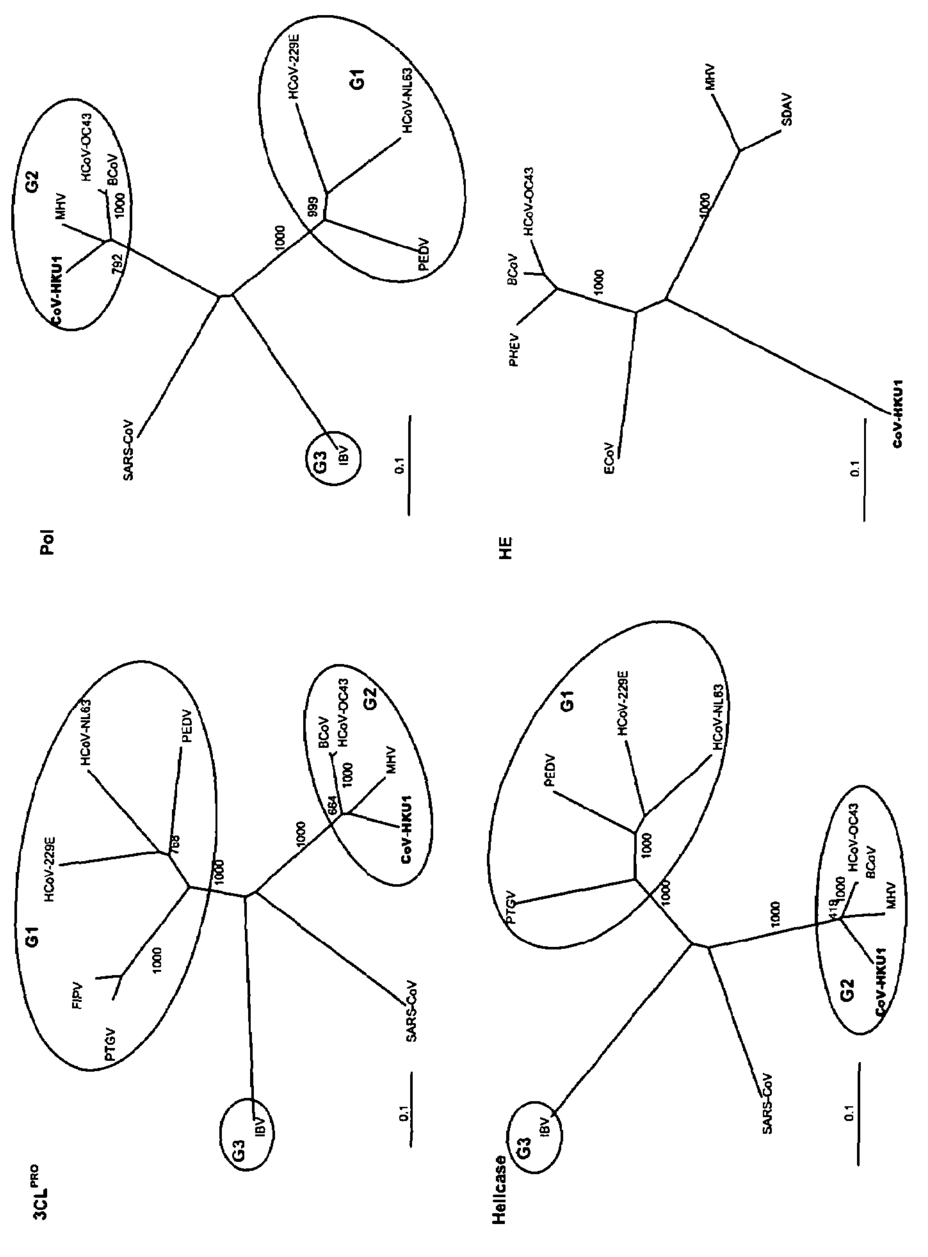
Figure 5B:
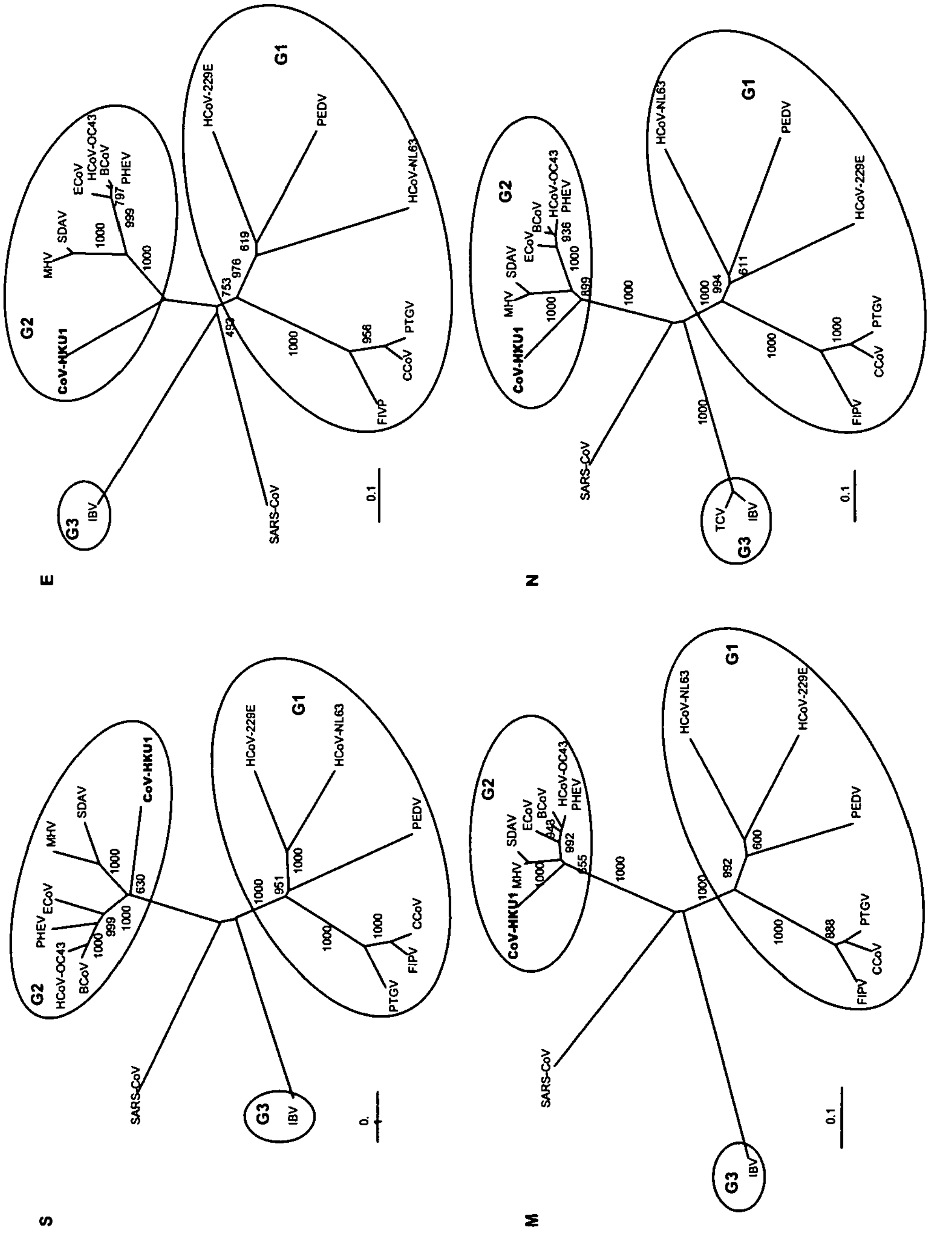

FIG. 5A shows the phylogenetic analysis of the chymotrypsin like protease (3CL$^{pro}$), RNA-dependent RNA polymerase (Pol), helicase, and hemagglutinin-esterase (HE); and FIG. 5B shows that of the spike (S), envelope (E), membrane (M), and nucleocapsid (N) proteins of CoV-HKU1. The trees were constructed by the neighbor joining method using the Jukes-Cantor correction and bootstrap values were calculated from 1000 trees. A total of 303, 928, 595, 418, 1356, 75, 225 and 406 amino acid positions in 3CL$^{pro}$, Pol, helicase, HE, S, E, M, and N, respectively, were included in the analysis. The scale bar indicates the estimated number of substitutions per 10 amino acids. HCoV-229E: human coronavirus 229E; PEDV: porcine epidemic diarrhea virus; PTGV: porcine transmissible gastroenteritis virus; CCoV, canine enteric coronavirus; HCoV-NL63: human coronavirus NL63; HCoV-OC43: human coronavirus OC43; MHV: murine hepatitis virus; BCoV: bovine coronavirus; SDAV: rat sialodacryoadnitis coronavirus; ECoV: equine coronavirus NC99; PHEV: porcine hemagglutinating encephalomyelitis virus; IBV: infectious bronchitis virus; SARS-CoV: SARS coronavirus.

Figure 6:
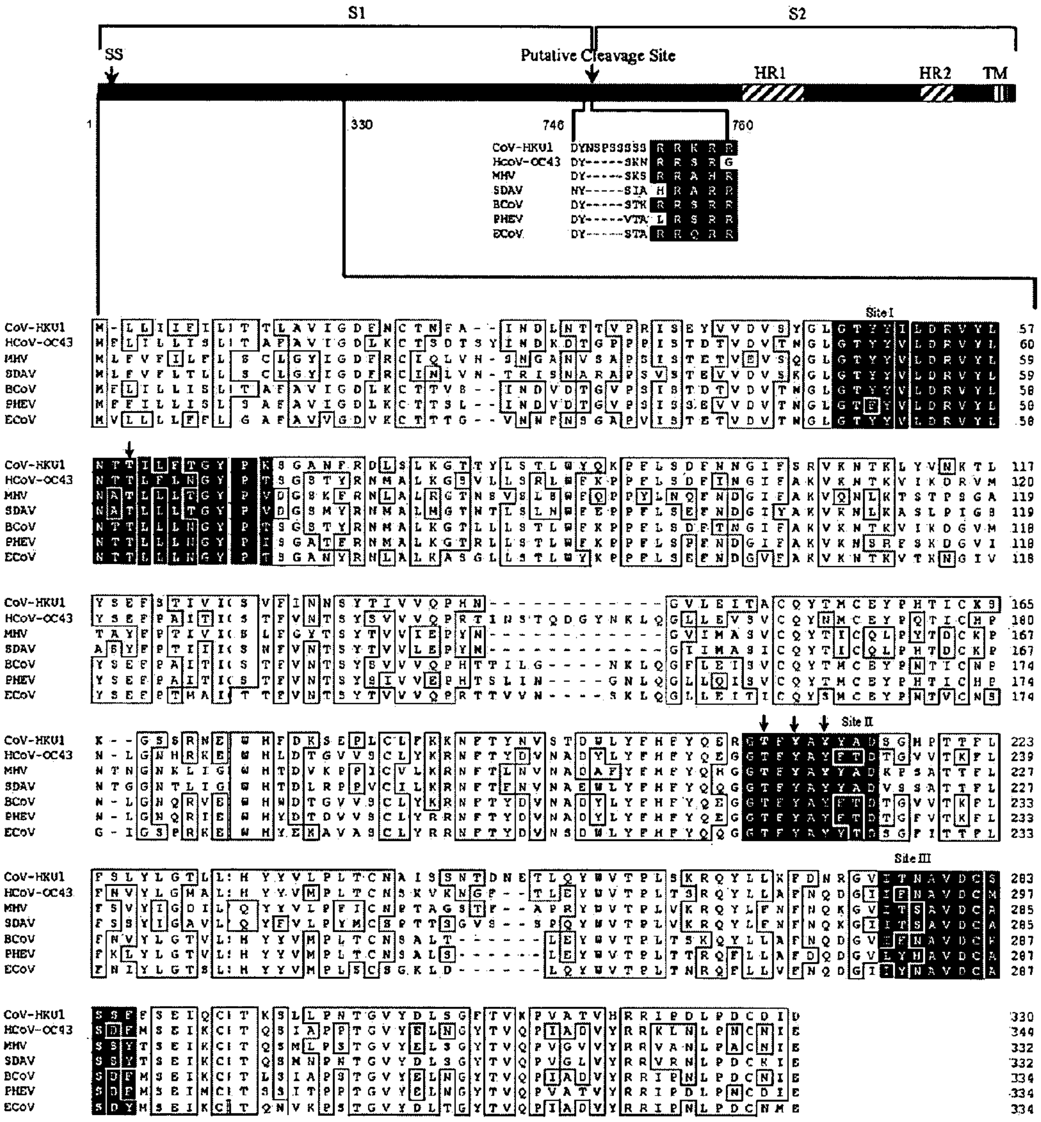

FIG. 6 shows the spike protein of CoV-HKU1 (residues 7-336 of SEQ ID NO: 420) and those of other group 2 coronaviruses (SEQ ID NOS 21-26, respectively, in order of appearance). The spike protein (1356 amino acids) of CoV-HKU1 is depicted by the horizontal bar [SS=N terminal signal sequence (amino acid residues 1 to 13), HR1=heptad repeat 1 (amino acid residues 982 to 1083), HR2=heptad repeat 2 (amino acid residues 1250 to 1297), TM=transmembrane domain (amino acid residues 1301 to 1323)], (the seven sequences below the horizontal bar disclose residues 752-766 of SEQ ID NO: 420 and SEQ ID NOS 28-33, respectively, in order of appearance). Alignment of the N-terminal region important for receptor binding (amino acid residues 1 to 330) and the region upstream to the cleavage site between S1 and S2 of CoV-HKU1 and other group 2 coronaviruses was generated with ClustalX 1.83. Residues that match the CoV-HKU1 exactly are boxed. The three conserved regions (sites I, II, and III) for receptor binding in MHV are shaded. The positions of the four conserved amino acids important for receptor binding in MHV are indicated with arrows. (GenBank accession nos. MHV: P11224; BCoV: NP 150077; HCoV-OC43: NP 937950; SDAV: AAF97738; PHEV: AAL80031; ECoV: AAQ67205).

Figure 7:
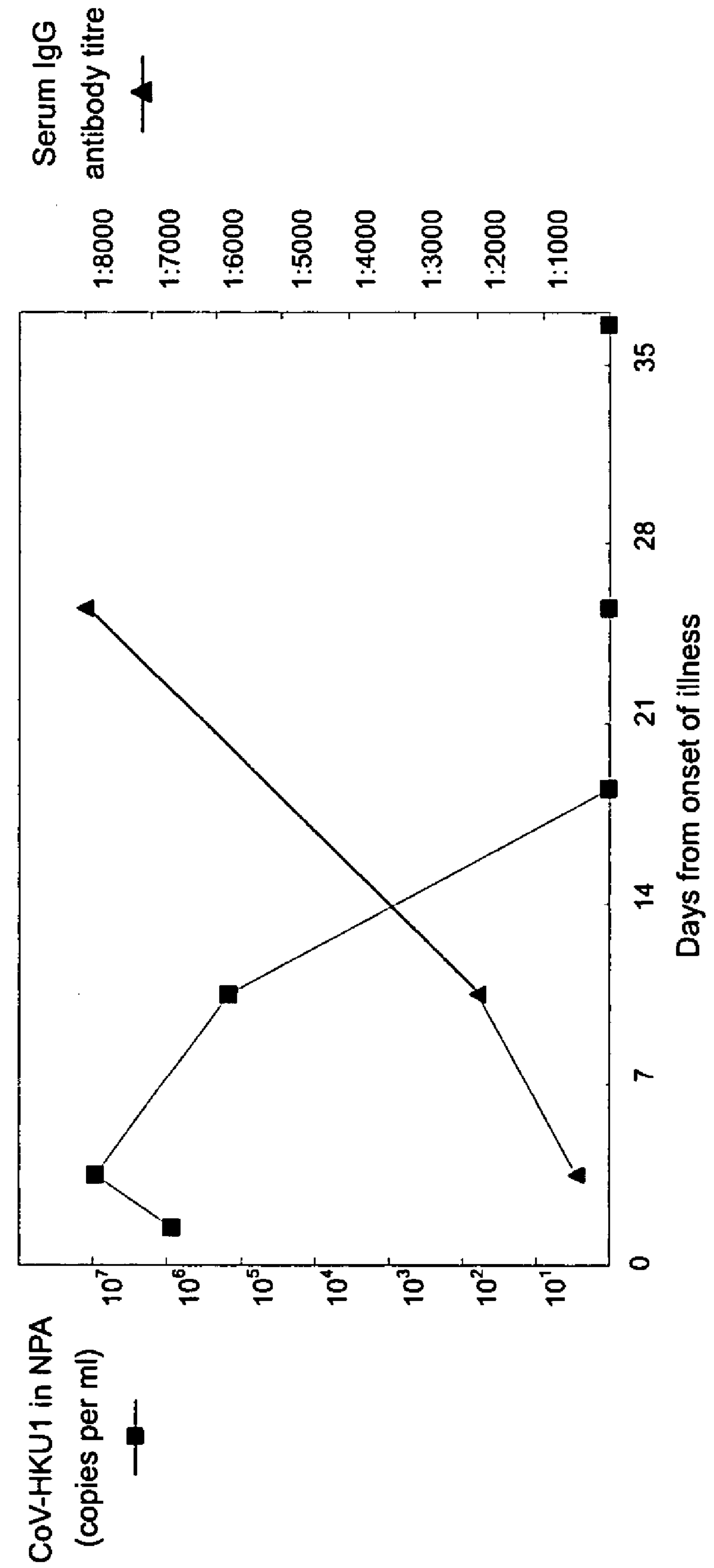

FIG. 7 shows the sequential quantitative RT-PCR (closed squares; copies/ml) for CoV-HKU1 in nasopharyngeal aspirates; and serum IgG antibody titers against N protein of CoV-HKU1 (closed triangles).

Figure 8:
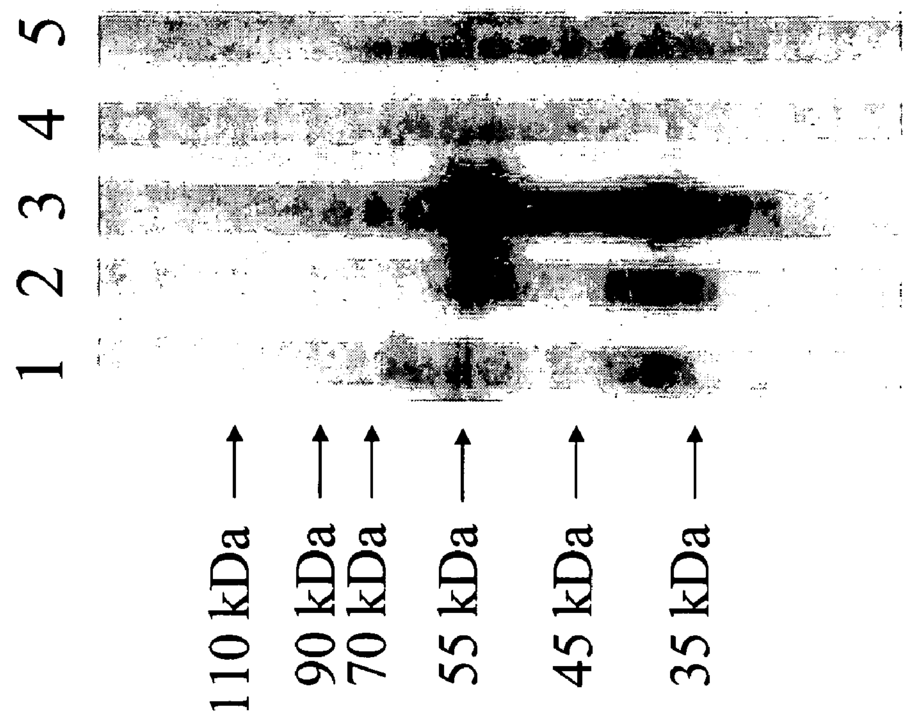

FIG. 8 shows the Western blot analysis of purified recombinant CoV-HKU1 N protein antigen. Prominent immunoreactive protein bands of about 53 kDa (i.e., purified recombinant CoV-HKU1 N protein) were detected by the Western blot using the patient's sera obtained during the second and fourth weeks of the illness (lanes 2 and 3). Only very faint bands were observed with the serum samples obtained from the patient during the first week of the illness (lane 1) and two healthy blood donors (lane 4 and 5), respectively.

FIG. 9 shows the entire genomic DNA sequence (SEQ ID NO:2919) of CoV-HKU1 and its deduced amino acid sequences therefrom in three frames. An asterisk (*) indicates a stop codon which marks the end of a peptide. The first-frame translation and amino acid sequences: SEQ ID NOS: 2970-3474; the second-frame translation and amino acid sequences: SEQ ID NOS: 3475-3721; and the third-frame translation and amino acid sequences: SEQ ID NOS: 3722-4236.

FIG. 10 shows arrangements of proteins in replicase polyprotein in CoV-HKU1 compared with those in HCoV-OC43, BCoV, and MHV. Alignment of the AC domains of HCoV-OC43 (SEQ ID NO: 4239), BCoV (SEQ ID NO: 4238), and MHV (SEQ ID NO: 4237) and the AC domains and ATR (underlined) of CoV-HKU1 in the two patients (SEQ ID NOS 4240 and 4241) was generated with ClustalX 1.83. AC domain=acidic domain, ATR=acidic tandem repeat. (GenBank accession no. MHV: NC_001846; BCoV: NC_003045; HCoV-OC43: AY585229).

FIG. 11 shows the multiple alignments of the replicase genes of CoV-HKU1 from patients 1 (SEQ ID NO: 2920 which encodes SEQ ID NO: 2921), 2 (SEQ ID NO: 2922 which encodes SEQ ID NO: 2923), 4 (SEQ ID NO: 2924 which encodes SEQ ID NO: 2925), 5 (SEQ ID NO: 4242 which encodes SEQ ID NO: 4243), 6 (SEQ ID NO: 2926 which encodes SEQ ID NO: 2927), 7 (SEQ ID NO: 2928 which encodes SEQ ID NO: 2929), 8 (SEQ ID NO: 2930 which encodes SEQ ID NO: 2931), 9 (SEQ ID NO: 2932 which encodes SEQ ID NO: 2933) and 10 (SEQ ID NO: 2934 which encodes SEQ ID NO: 2935).

Figure 12:
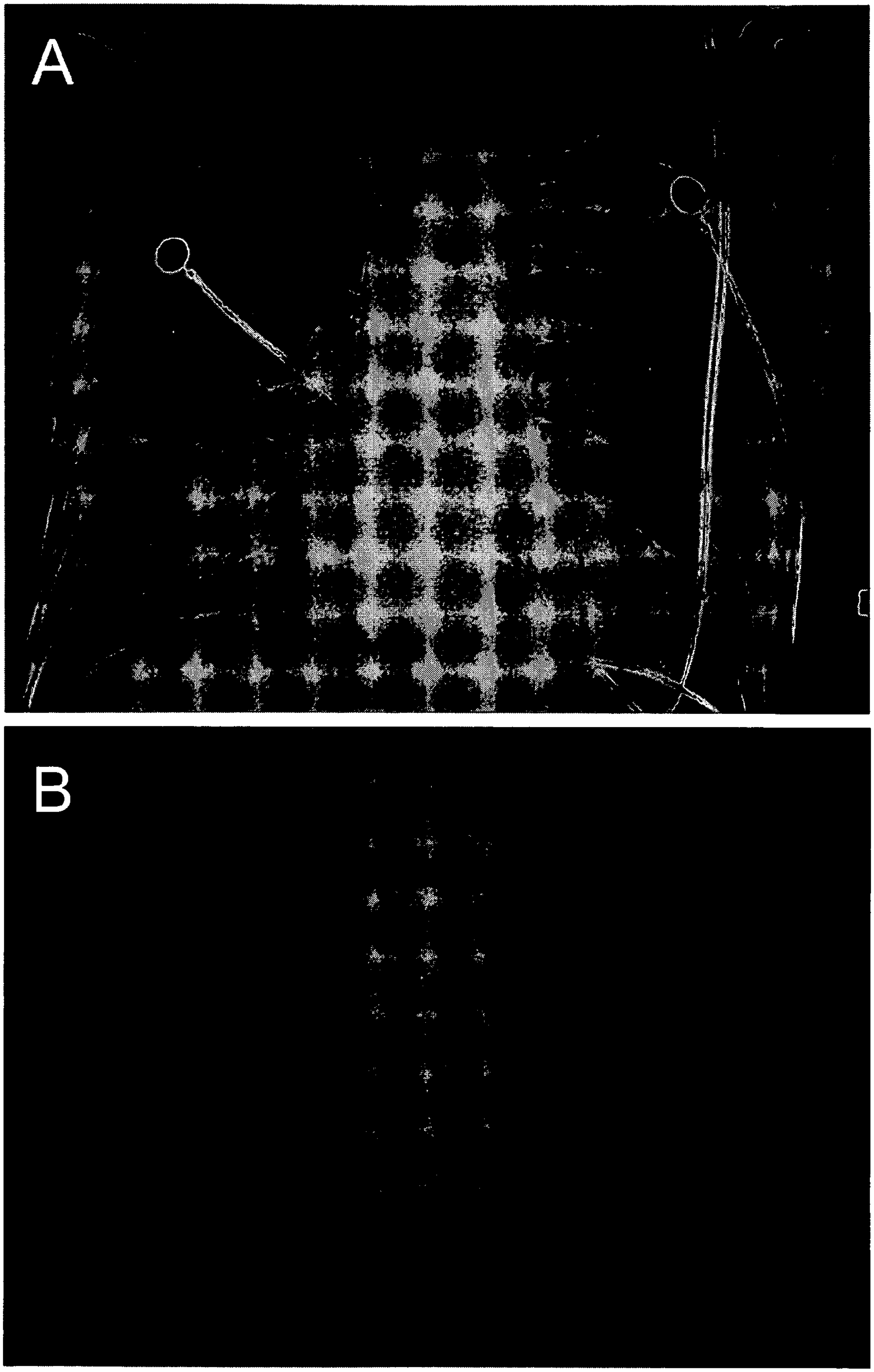

FIG. 12 shows the chest radiographs of the two patients who died of community acquired pneumonia associated with CoV-HKU1. The chest radiograph of the first patient (FIG. 12A; patient no. 2 in Table 5) showed patchy airspace shadows in both lungs with predominant involvement of the lower zones. The chest radiograph of the second patient (FIG. 12B; patient no. 10 in Table 5), with Luque instrumentation in situ, showed extensive airspace shadows in both lungs with the middle zones more severely involved.

FIG. 13 shows the multiple alignments of the spike genes of CoV-HKU1 from patients 1 (SEQ ID NO: 2936 which encodes SEQ ID NO: 2937), 2 (SEQ ID NO: 2938 which encodes SEQ ID NO: 2939), 4 (SEQ ID NO: 2940 which encodes SEQ ID NO: 2941), 5 (SEQ ID NO: 4244 which encodes SEQ ID NO: 4245), 6 (SEQ ID NO: 2942 which encodes SEQ ID NO: 2943), 7 (SEQ ID NO: 2944 which encodes SEQ ID NO: 2945), 8 (SEQ ID NO: 2946 which encodes SEQ ID NO: 2947), 9 (SEQ ID NO: 2948 which encodes SEQ ID NO: 2949) and 10 (SEQ ID NO: 2950 which encodes SEQ ID NO: 2951).

FIG. 14 shows the multiple alignments of the nucleocapsid genes of CoV-HKU1 from patients 1 (SEQ ID NO: 2952 which encodes SEQ ID NO: 2953), 2 (SEQ ID NO: 2954 which encodes SEQ ID NO: 2955), 4 (SEQ ID NO: 2956 which encodes SEQ ID NO: 2957), 5 (SEQ ID NO: 4246 which encodes SEQ ID NO: 4247), 6 (SEQ ID NO: 2958 which encodes SEQ ID NO: 2959), 7 (SEQ ID NO: 2960 which encodes SEQ ID NO: 2961), 8 (SEQ ID NO: 2962 which encodes SEQ ID NO: 2963), 9 (SEQ ID NO: 2964 which encodes SEQ ID NO: 2965) and 10 (SEQ ID NO: 2966 which encodes SEQ ID NO: 2967).

Figure 15:
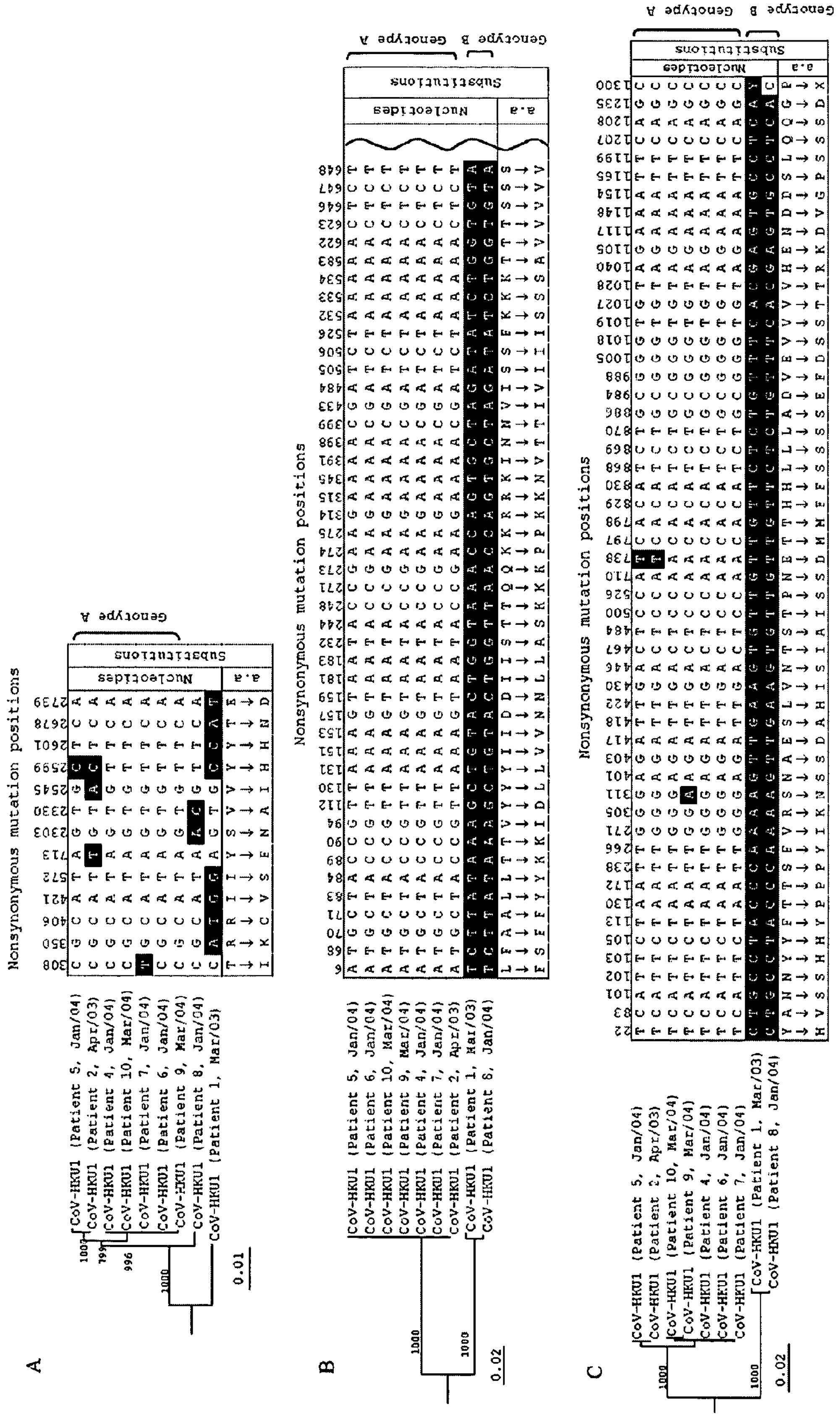

FIG. 15 shows phylogenetic trees and non-synonymous mutations and corresponding amino acid changes of complete pol, S and N gene sequences of CoV-HKU1 from nine patients with community acquired pneumonia. The trees were inferred from pol (FIG. 15A), S (FIG. 15B) and N (FIG. 15C) gene data by the neighbor-joining method and bootstrap values calculated from 1000 trees. The trees were rooted using pol, S and N gene sequences of HCoV-OC43, respectively. 2784 nucleotide positions in each pol gene, 4071 nucleotide positions in each S gene, and 1326 nucleotide positions in each N gene, were included in the analysis. The scale bar indicates the estimated number of substitutions per 100 (FIG. 15A) and 50 (FIGS. 15B and 15C) bases, respectively, using Jukes-Cantor correction. The shaded nucleotides are those that differ from the majority at the corresponding locations. Due to the large number of non-synonymous mutations in the S gene, only the $NH_2$ terminal 45, out of the total of 306, non-synonymous mutations are shown.

FIG. 16 shows the multiple alignments of nucleotides 1806-1835 and 2229-2258 of the pol genes in the nine CoV-HKU1 and those of HCoV-OC43, HCoV-229E, HCoV-NL63 and SARS-CoV. Marked differences between the 3' ends of the two primers for RT-PCR (LPW1926; SEQ ID NO: 2968 and LPW1927; SEQ ID NO: 2969) and the corresponding bases in HCoV-OC43 (SEQ ID NOS 4250 and 4251), HCoV-229E (SEQ ID NOS: 4254 and 4255), HCoV-NL63 (SEQ ID NOS: 4256 and 4257) and SARS-CoV (SEQ ID NOS: 4252 and 4253) are observed, indicating the high specificity of the two primers for CoV-HKU1. The positions of LPW1926 (SEQ ID NO: 2968) and LPW1927 (SEQ ID NO: 2969) are boxed. The bases in HCoV-OC43, HCoV-229E, HCoV-NL63 and SARS-CoV that were different from those in the sequence of the primers, were shaded.

Figure 17:
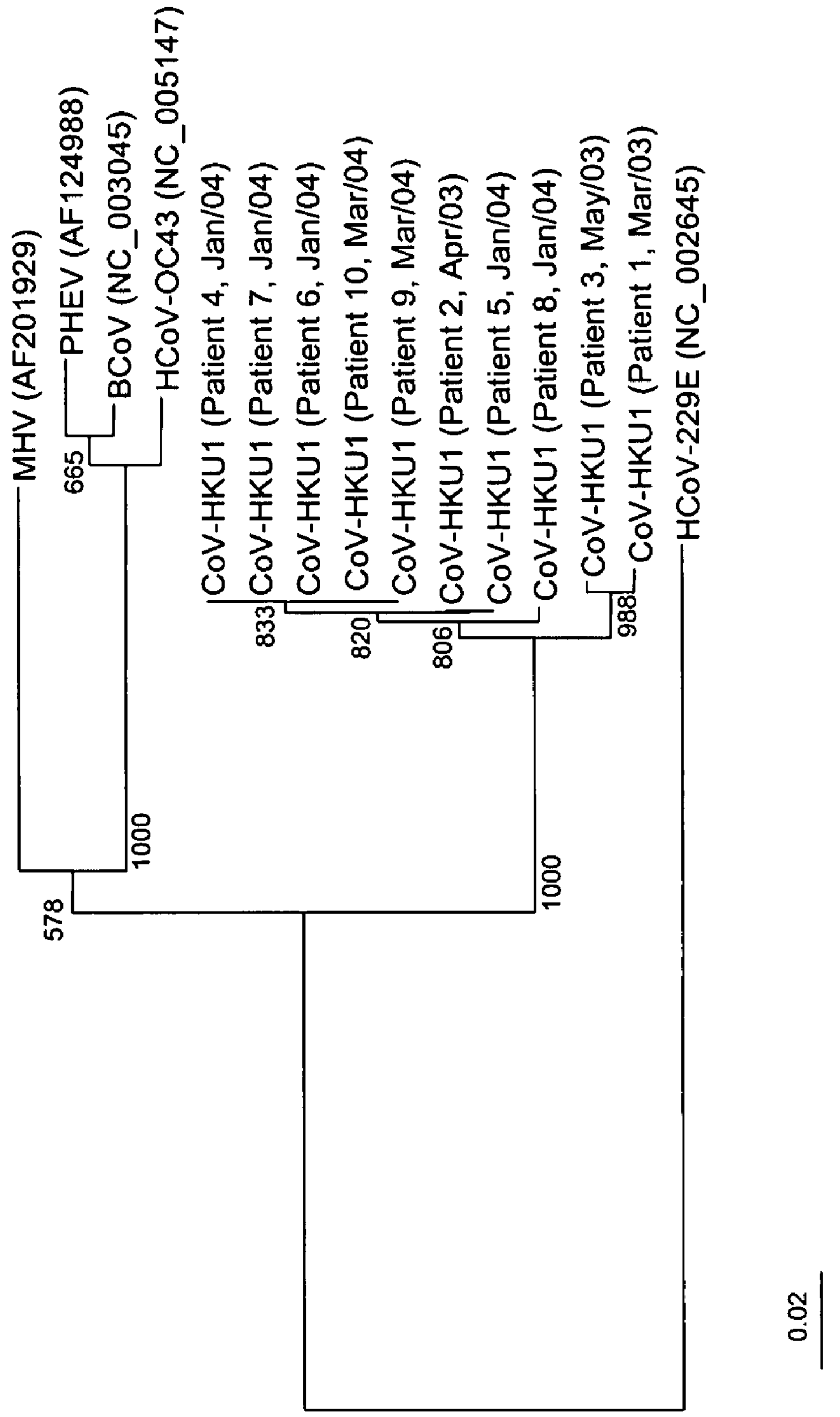

FIG. 17 show a phylogenetic tree of pol gene sequences of the 10 CoV-HKU1 from patients with community acquired pneumonia. The tree was inferred from pol gene data by the neighbor-joining method and bootstrap values calculated from 1000 trees. The tree was rooted using pol gene sequence of HCoV:229E and 393 nucleotide positions (primer sequences excluded) in each pol gene were included in the analysis. The scale bar indicates the estimated number of substitutions per 50 bases using Jukes-Cantor correction. CoV-HKU1: human coronavirus HKU1; HCoV-229E: human coronavirus 229E; HCoV-OC43: human coronavirus OC43; MHV: murine hepatitis virus; BCoV: bovine coronavirus; PHEV: porcine hemagglutinating encephalomyelitis virus.

5. DETAILED DESCRIPTION OF THE INVENTION

The present invention relates to the CoV-HKU1 that phylogenetically relates to known *Coronaviruses*. In a specific embodiment, CoV-HKU1 comprises a nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966. In a specific embodiment, the present invention provides isolated nucleic acid molecules of the CoV-HKU1, comprising, or, alternatively, consisting of the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, a complement thereof or a portion thereof. In another specific embodiment, the invention provides isolated nucleic acid molecules which hybridize under stringent conditions, as defined herein, to a nucleic acid molecule having the sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or specific genes of known member of Coronaviridae, or a complement thereof. In another specific embodiment, the invention provides isolated polypeptides or proteins that are encoded by a nucleic acid molecule comprising a nucleotide sequence that is at least about 5, 10, 15, 20, 25, 30, 35, 40, 45, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2,100, 2,200, 2,300, 2,400, 2,500, 2,600, 2,700, or more contiguous nucleotides of the nucleotide sequence of SEQ ID NO:1, 2920, 2922, 2924, 2926, 2928, 2930, 2932, or 2934, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 1,250, 1,300, 1,350, 1,400, 1,450, 1,500, 1,550, 1,600, 1,650, 1,700, 1,750, 1,800, 1,850, 1,900, 1,950, 2,000, 2,100, 2,200, 2,300, 2,400, 2,500, 2,600, 2,700, 2,800, 2,900, 3,000, 3,100, 3,200, 3,300, 3,400, 3,500, 3,600, 3,700, 3,800, 3,900, 4,000, or more contiguous nucleotides of the nucleotide sequence of SEQ ID NO:2936, 2938, 2940, 2942, 2944, 2946, 2948, or 2950, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 1,250, 1,300, or more contiguous nucleotides of the nucleotide sequence of SEQ ID NO:2952, 2954, 2956, 2958, 2960, 2962, 2964, or 2966, a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 250, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:3 or 2919, or a complement thereof. The polypeptides or the proteins of the present invention preferably have one or more biological activities of the proteins encoded by the sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or the native viral proteins containing the amino acid sequences encoded by the sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a portion thereof.

The invention further relates to the use of the sequence information of the isolated virus for diagnostic and therapeutic methods. In a specific embodiment, the invention provides the entire nucleotide sequence of CoV-HKU1 (SEQ ID NO:3 or 2919), or fragments, or complement thereof. Furthermore, the present invention relates to a nucleic acid molecule that hybridizes any portion of the genome of the CoV-HKU1 (SEQ ID NO:3 or 2919) under the stringent conditions. In a specific embodiment, the invention provides nucleic acid molecules which are suitable for use as primers consisting of or comprising the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a complement thereof, or a portion thereof. In another specific embodiment, the invention provides nucleic acid molecules which are suitable for use as hybridization probes for the detection of nucleic acids encoding a polypeptide of the invention, consisting of or comprising the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, a complement thereof, or a portion thereof. The invention further encompasses chimeric or recombinant viruses or viral proteins encoded by said nucleotide sequences.

The invention further provides antibodies that specifically bind a polypeptide of the invention encoded by the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a fragment thereof, or any CoV-HKU1 epitope as well as the polypeptides having the amino acid sequqences of any one of SEQ ID NO:2, SEQ ID NOS:34-2918 shown in FIGS. 2 and 3, SEQ ID NOS:2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and 2970-4236 shown in FIG. 9. Such antibodies include, but are not limited to polyclonal, monoclonal, bi-specific, multi-specific, human, humanized, chimeric antibodies, single chain antibodies, Fab fragments, $F(ab')_2$ fragments, disulfide-linked Fvs, intrabodies and fragments containing either a VL or VH domain or even a complementary determining region (CDR) that specifically binds to a polypeptide of the invention.

In one embodiment, the invention provides methods for detecting the presence, activity or expression of the CoV-HKU1 of the invention in a biological material, such as cells, blood, saliva, urine, sputum, nasopharyngeal aspirates, and so forth. The presence of the CoV-HKU1 in a sample can be determined by contacting the biological material with an agent which can detect directly or indirectly the presence, activity or expression of the CoV-HKU1. In a specific embodiment, the detection agents are the antibodies of the present invention. In another embodiment, the detection agent is a nucleic acid of the present invention.

In another embodiment, the invention provides vaccine preparations comprising the CoV-HKU1 recombinant and chimeric forms of said virus, or subunits of the virus.

The present invention further provides methods of preparing recombinant or chimeric forms of CoV-HKU1. In another specific embodiment, the vaccine preparations of the present invention comprise one or more nucleic acid molecules comprising or consisting of the sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a fragment thereof. In another embodiment, the invention provides vaccine preparations comprising one or more polypeptides of the invention encoded by a nucleotide sequence comprising or consisting of the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a fragment thereof, including the polypeptides having the amino acid sequences of SEQ ID NO:2, SEQ ID NOS:34-2918, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and/or 2970-4236. Furthermore, the present invention provides methods for treating, ameliorating, managing, or preventing respiratory tract infections by administering to a subject in need thereof the anti-viral agents of the present invention, alone or in combination with other antivirals [e.g., amantadine, rimantadine, gancyclovir, acyclovir, ribavirin, penciclovir, oseltamivir, foscarnet zidovudine (AZT), didanosine (ddI), lamivudine (3TC), zalcitabine (ddC), stavudine (d4T), nevirapine, delavirdine, indinavir, ritonavir, vidarabine, nelfinavir, saquinavir, relenza, tamiflu, pleconaril, interferons, etc.], steroids and corticosteroids such as prednisone, cortisone, fluticasone and glucocorticoid, antibiotics, analgesics, bronchodialaters, or other treatments for respiratory and/or viral infections. In one aspect, the anti-viral agent of the present invention prevents or inhibit the binding of the virus or viral proteins to a host cell under a physiological condition, thereby preventing or inhibiting the infection of the host cell by the virus. In another aspect, the anti-viral agent of the invention prevents or inhibits replication of the viral nucleic acid molecules in the host cell under a physiological condition by interacting with the viral nucleic acid molecules or its transcription mechanisms. In a specific embodiment, the anti-viral agent of the invention includes the vaccine or immunogenic preparations of the invention or an antibody that immunospecifically binds CoV-HKU1 or any CoV-HKU1 epitope and may neutralizes CoV-HKU1. In another specific embodiment, the anti-viral agent is a polypeptide or protein of the invention or a nucleic acid molecule of the invention. In addition, the present invention provides a method of preventing or inhibiting replication in a host cell of a nucleic acid molecule having the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or inhibiting the activities of the polypeptides encoded by the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, a complement thereof, or a portion thereof, including the polypeptides having the amino acid sequence of SEQ ID NO:2, SEQ ID NO:34-2918, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and/or 2970-4236, by administering to said host cell the anti-viral agent of the invention. In a specific embodiment the host cell is a mammalian cell, such as a cell of humans, primates, horses, cows, sheep, pigs, goats, dogs, cats, arivan species and rodents. Preferably, the cell is a primate cell and most preferably a human cell.

Furthermore, the present invention provides pharmaceutical compositions comprising anti-viral agents of the present invention and a pharmaceutically acceptable carrier. The present invention also provides kits comprising pharmaceutical compositions of the present invention.

5.1 Recombinant and Chimeric CoV-HKU1

The present invention encompasses recombinant or chimeric viruses encoded by viral vectors derived from the genome of CoV-HKU 1 or natural variants thereof. In a specific embodiment, a recombinant virus is one derived from the CoV-HKU1. In a specific embodiment, the virus has a nucleotide sequence of SEQ ID NO:3 or 2919. In another specific embodiment, a recombinant virus is one derived from a natural variant of CoV-HKU1. A natural variant of CoV-HKU1 has a sequence that is different from the genomic sequence (SEQ ID NO:3 or 2919) of CoV-HKU1, due to one or more naturally occurred mutations, including, but not limited to, point mutations, rearrangements, insertions, deletions etc., to the genomic sequence that may or may not result in a phenotypic change. In accordance with the present invention, a viral vector which is derived from the genome of the CoV-HKU, is one that contains a nucleic acid sequence that encodes at least a part of one ORF of the CoV-HKU1. In a specific embodiment, the ORF comprises or consists of a nucleotide sequence of SEQ ID NO:1, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a fragment thereof. In a specific embodiment, there are more than one ORF within the nucleotide sequence of SEQ ID NO:3 or 2919, or a fragment thereof. In another embodiment, the polypeptides encoded by the ORF comprises or consists of amino acid sequences of SEQ ID NO:34-2918 shown in FIGS. 2 and 8, or SEQ ID NO:2, SEQ ID NO:2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and/or 2970-4236, or a fragment thereof. In accordance with the present invention these viral vectors may or may not include nucleic acids that are non-native to the viral genome.

In another specific embodiment, a chimeric virus of the invention is a recombinant CoV-HKU1 which further comprises a heterologous nucleotide sequence. In accordance with the invention, a chimeric virus may be encoded by a nucleotide sequence in which heterologous nucleotide sequences have been added to the genome or in which endogenous or native nucleotide sequences have been replaced with heterologous nucleotide sequences.

According to the present invention, the chimeric viruses are encoded by the viral vectors of the invention which further comprise a heterologous nucleotide sequence. In accordance with the present invention a chimeric virus is encoded by a viral vector that may or may not include nucleic acids that are non-native to the viral genome. In accordance with the invention a chimeric virus is encoded by a viral vector to which heterologous nucleotide sequences have been added, inserted or substituted for native or non-native sequences. In accordance with the present invention, the chimeric virus may be encoded by nucleotide sequences derived from different strains or variants of CoV-HKU1. In particular, the chimeric virus is encoded by nucleotide sequences that encode antigenic polypeptides derived from different strains or variants of CoV-HKU1.

A chimeric virus may be of particular use for the generation of recombinant vaccines protecting against two or more viruses (Tao et al., J. Virol. 72, 2955-2961; Durbin et al., 2000, J. Virol. 74, 6821-6831; Skiadopoulos et al., 1998, J. Virol. 72, 1762-1768 (1998); Teng et al., 2000, J. Virol. 74, 9317-9321). For example, it can be envisaged that a virus vector derived from the CoV-HKU1 expressing one or more proteins of variants of CoV-HKU1, or vice versa, will protect a subject vaccinated with such vector against infections by both the native CoV-HKU1 and the variant. Attenuated and replication-defective viruses may be of use for vaccination purposes with live vaccines as has been suggested for other viruses.

In accordance with the present invention the heterologous sequence to be incorporated into the viral vectors encoding the recombinant or chimeric viruses of the invention include sequences obtained or derived from different strains or variants of CoV-HKU1.

In certain embodiments, the chimeric or recombinant viruses of the invention are encoded by viral vectors derived from viral genomes wherein one or more sequences, intergenic regions, termini sequences, or portions or entire ORF have been substituted with a heterologous or non-native sequence. In certain embodiments of the invention, the chimeric viruses of the invention are encoded by viral vectors derived from viral genomes wherein one or more heterologous sequences have been inserted or added to the vector.

The selection of the viral vector may depend on the species of the subject that is to be treated or protected from a viral infection.

In accordance with the present invention, the viral vectors can be engineered to provide antigenic sequences which confer protection against infection by the CoV-HKU1 and natural variants thereof. The viral vectors may be engineered to provide one, two, three or more antigenic sequences. In accordance with the present invention the antigenic sequences may be derived from the same virus, from different strains or variants of the same type of virus, or from different viruses.

The expression products and/or recombinant or chimeric virions obtained in accordance with the invention may advantageously be utilized in vaccine formulations. The expression products and chimeric virions of the present invention may be engineered to create vaccines against a broad range of pathogens, including viral and bacterial antigens, tumor antigens, allergen antigens, and auto antigens involved in autoimmune disorders. In particular, the chimeric virions of the present invention may be engineered to create vaccines for the protection of a subject from infections with CoV-HKU1 and variants thereof.

In certain embodiments, the expression products and recombinant or chimeric virions of the present invention may be engineered to create vaccines against a broad range of pathogens, including viral antigens, tumor antigens and autoantigens involved in autoimmune disorders. One way to achieve this goal involves modifying existing CoV-HKU1 genes to contain foreign sequences in their respective external domains. Where the heterologous sequences are epitopes or antigens of pathogens, these chimeric viruses may be used to induce a protective immune response against the disease agent from which these determinants are derived.

Thus, the present invention relates to the use of viral vectors and recombinant or chimeric viruses to formulate vaccines against a broad range of viruses and/or antigens. The present invention also encompasses recombinant viruses comprising a viral vector derived from the CoV-HKU1 or variants thereof which contains sequences which result in a virus having a phenotype more suitable for use in vaccine formulations. The mutations and modifications can be in coding regions, in intergenic regions and in the leader and trailer sequences of the virus.

The invention provides a host cell comprising a nucleic acid or a vector according to the invention. Plasmid or viral vectors containing the polymerase components of CoV-HKU1 are generated in prokaryotic cells for the expression of the components in relevant cell types (bacteria, insect cells, eukaryotic cells). Plasmid or viral vectors containing full-length or partial copies of the CoV-HKU1 genome will be generated in prokaryotic cells for the expression of viral nucleic acids in-vitro or in-vivo. The latter vectors may contain other viral sequences for the generation of chimeric viruses or chimeric virus proteins, may lack parts of the viral genome for the generation of replication defective virus, and may contain mutations, deletions or insertions for the generation of attenuated viruses.

In addition, eukaryotic cells, transiently or stably expressing one or more full-length or partial CoV-HKU1 proteins can be used. Such cells can be made by transfection (proteins or nucleic acid vectors), infection (viral vectors) or transduction (viral vectors) and may be useful for complementation of mentioned wild type, attenuated, replication-defective or chimeric viruses.

The viral vectors and chimeric viruses of the present invention may be used to modulate a subject's immune system by stimulating a humoral immune response, a cellular immune response or by stimulating tolerance to an antigen. As used herein, a subject means: humans, primates, horses, cows, sheep, pigs, goats, dogs, cats, avian species and rodents.

5.2 Formulation of Vaccines and Antivirals

In a preferred embodiment, the invention provides a proteinaceous molecule or CoV-HKU1 specific viral protein or functional fragment thereof encoded by a nucleic acid according to the invention. Useful proteinaceous molecules are for example derived from any of the genes or genomic fragments derivable from the virus according to the invention, including envelop protein (E protein), integral membrane protein (M protein), spike protein (S protein), nucleocapsid protein (N protein), hemagglutinin esterase (HE protein), and RNA-dependent RNA polymerase. Such molecules, or antigenic fragments thereof, as provided herein, are for example useful in diagnostic methods or kits and in pharmaceutical compositions such as subunit vaccines. Particularly useful are polypeptides encoded by the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, including the polypeptides having the amino acid sequences of SEQ ID NOS:34-2918 in FIGS. 2 and 3, or SEQ ID NO:2, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and/or 2970-4236 in FIG. 9, or antigenic fragments thereof for inclusion as antigen or subunit immunogen, but inactivated whole virus can also be used. Particularly useful are also those proteinaceous substances that are encoded by recombinant nucleic acid fragments of the CoV-HKU1 genome; of course preferred are those that are within the preferred bounds and metes of ORFs, in particular, for eliciting CoV-HKU1 specific antibody or T cell responses, whether in vivo (e.g. for protective or therapeutic purposes or for providing diagnostic antibodies) or in vitro (e.g. by phage display technology or another technique useful for generating synthetic antibodies).

The invention provides vaccine formulations for the prevention and treatment of infections with CoV-HKU1. In certain embodiments, the vaccine of the invention comprises recombinant and chimeric viruses of the CoV-HKU1.

In another aspect, the present invention also provides DNA vaccine formulations comprising a nucleic acid or fragment of the CoV-HKU1, or nucleic acid molecules having the sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a fragment thereof. In another specific embodiment, the DNA vaccine formulations of the present invention comprises a nucleic acid or fragment thereof encoding the antibodies which immunospecifically binds CoV-HKU1. In DNA vaccine formulations, a vaccine DNA comprises a viral vector, such as that derived from the CoV-HKU1, bacterial plasmid, or other expression vector, bearing an insert comprising a nucleic acid molecule of the present invention operably linked to one or more control elements, thereby allowing expression of the vaccinating proteins encoded by said nucleic acid molecule in a vaccinated subject. Such vectors can be prepared by recombinant DNA technology as recombinant or chimeric viral vectors carrying a nucleic acid molecule of the present invention.

Various heterologous vectors are described for DNA vaccinations against viral infections. For example, the vectors described in the following references may be used to express CoV-HKU1 sequences instead of the sequences of the viruses or other pathogens described; in particular, vectors described for hepatitis B virus (Michel, M. L. et al., 1995, DAN-mediated immunization to the hepatitis B surface antigen in mice: Aspects of the humoral response mimic hepatitis B viral infection in humans, *Proc. Natl. Aca. Sci. USA* 92:5307-5311; Davis, H. L. et al., 1993, DNA-based immunization induces continuous seretion of hepatitis B surface antigen and high levels of circulating antibody, *Human Molec. Genetics* 2:1847-1851), HIV virus (Wang, B. et al., 1993, Gene inoculation generates immune responses against human imunodeficiency virus type 1, *Proc. Natl. Acad. Sci. USA* 90:4156-4160; Lu, S. et al., 1996, Simian immunodeficiency virus DNA vaccine trial in macques, *J. Virol*. 70:3978-3991; Letvin, N. L. et al., 1997, Potent, protective anti-HIV immune responses generated by bimodal HIV envelope DNA plus protein vaccination, *Proc Natl Acad Sci USA*. 94(17):9378-83), and influenza viruses (Robinson, H L et al., 1993, Protection against a lethal influenza virus challenge by immunization with a haemagglutinin-expressing plasmid DNA, *Vaccine* 11:957-960; Ulmer, J. B. et al., Heterologous protection against influenza by injection of DNA encoding a viral protein, *Science* 259:1745-1749), as well as bacterial infections, such as tuberculosis (Tascon, R. E. et al., 1996, Vaccination against tuberculosis by DNA injection, *Nature Med*. 2:888-892; Huygen, K. et al., 1996, Immunogenicity and protective efficacy of a tuberculosis DNA vaccine, *Nature Med*., 2:893-898), and parasitic infection, such as malaria (Sedegah, M., 1994, Protection against malaria by immunization with plasmid DNA encoding circumsporozoite protein, *Proc. Natl. Acad. Sci. USA* 91:9866-9870; Doolan, D. L. et al., 1996, Circumventing genetic restriction of protection against malaria with multigene DNA immunization: CD8+ T cell-interferon δ, and nitric oxide-dependent immunity, *J. Exper. Med*., 1183:1739-1746).

Many methods may be used to introduce the vaccine formulations described above. These include, but are not limited to, oral, intradermal, intramuscular, intraperitoneal, intravenous, subcutaneous, and intranasal routes. Alternatively, it may be preferable to introduce the chimeric virus vaccine formulation via the natural route of infection of the pathogen for which the vaccine is designed. The DNA vaccines of the present invention may be administered in saline solutions by injections into muscle or skin using a syringe and needle (Wolff J. A. et al., 1990, Direct gene transfer into mouse muscle in vivo, *Science* 247:1465-1468; Raz, E., 1994, Intradermal gene immunization: The possible role of DNA uptake in the induction of cellular immunity to viruses, *Proc. Natl. Acd. Sci. USA* 91:9519-9523). Another way to administer DNA vaccines is called "gene gun" method, whereby microscopic gold beads coated with the DNA molecules of interest is fired into the cells (Tang, D. et al., 1992, Genetic immunization is a simple method for eliciting an immune response, *Nature* 356:152-154). For general reviews of the methods for DNA vaccines, see Robinson, H. L., 1999, DNA vaccines: basic mechanism and immune responses (Review), *Int. J. Mol. Med*. 4(5):549-555; Barber, B., 1997, Introduction: Emerging vaccine strategies, *Seminars in Immunology* 9(5):269-270; and Robinson, H. L. et al., 1997, DNA vaccines, *Seminars in Immunology* 9(5):271-283.

5.3 Adjuvants and Carrier Molecules

CoV-HKU1-associated antigens are administered with one or more adjuvants. In one embodiment, the CoV-HKU1-associated antigen is administered together with a mineral salt adjuvants or mineral salt gel adjuvant. Such mineral salt and mineral salt gel adjuvants include, but are not limited to, aluminum hydroxide (ALHYDROGEL, REHYDRAGEL), aluminum phosphate gel, aluminum hydroxyphosphate (ADJU-PHOS), and calcium phosphate.

In another embodiment, CoV-HKU1-associated antigen is administered with an immunostimulatory adjuvant. Such class of adjuvants, include, but are not limited to, cytokines (e.g., interleukin-2, interleukin-7, interleukin-12, granulocyte-macrophage colony stimulating factor (GM-CSF), interfereon-γinterleukin-1β (IL-1β), and IL-1β peptide or Sclavo Peptide), cytokine-containing liposomes, triterpenoid glycosides or saponins (e.g., QuilA and QS-21, also sold under the trademark STIMULON, ISCOPREP), Muramyl Dipeptide (MDP) derivatives, such as N-acetyl-muramyl-L-threonyl-D-isoglutamine (Threonyl-MDP, sold under the trademark TERMURTIDE), GMDP, N-acetyl-nor-muramyl-L-alanyl-D-isoglutamine, N-acetylmuramyl-L-alanyl-D-isoglutaminyl-L-alanine-2-(1'-2'-dipalmitoyl-sn-glycero-3-hydroxy phosphoryloxy)-ethylamine, muramyl tripeptide phosphatidylethanolamine (MTP-PE), unmethylated CpG dinucleotides and oligonucleotides, such as bacterial DNA and fragments thereof, LPS, monophosphoryl Lipid A (3D-MLA sold under the trademark MPL), and polyphosphazenes.

In another embodiment, the adjuvant used is a particular adjuvant, including, but not limited to, emulsions, e.g., Freund's Complete Adjuvant, Freund's Incomplete Adjuvant, squalene or squalane oil-in-water adjuvant formulations, such as SAF and MF59, e.g., prepared with block-copolymers, such as L-121 (polyoxypropylene/polyoxyetheylene) sold under the trademark PLURONIC L-121, Liposomes, Virosomes, cochleates, and immune stimulating complex, which is sold under the trademark ISCOM.

In another embodment, a microparticular adjuvant is used. Microparticulare adjuvants include, but are not limited to biodegradable and biocompatible polyesters, homo- and copolymers of lactic acid (PLA) and glycolic acid (PGA), poly(lactide-co-glycolides) (PLGA) microparticles, polymers that self-associate into particulates (poloxamer particles), soluble polymers (polyphosphazenes), and virus-like particles (VLPs) such as recombinant protein particulates, e.g., hepatitis B surface antigen (HbsAg).

Yet another class of adjuvants that may be used include mucosal adjuvants, including but not limited to heat-labile enterotoxin from *Escherichia coli* (LT), cholera holotoxin (CT) and cholera Toxin B Subunit (CTB) from *Vibrio cholerae*, mutant toxins (e.g., LTK63 and LTR72), microparticles, and polymerized liposomes.

In other embodiments, any of the above classes of adjuvants may be used in combination with each other or with other adjuvants. For example, non-limiting examples of combination adjuvant preparations that can be used to administer the CoV-HKU1-associated antigens of the invention include liposomes containing immunostimulatory protein, cytokines, or T-cell and/or B-cell peptides, or microbes with or without entrapped IL-2 or microparticles containing enterotoxin. Other adjuvants known in the art are also included within the scope of the invention (see *Vaccine Design: The Subunit and Adjuvant Approach*, Chap. 7, Michael F. Powell and Mark J. Newman (eds.), Plenum Press, New York, 1995, which is incorporated herein in its entirety).

The effectiveness of an adjuvant may be determined by measuring the induction of antibodies directed against an immunogenic polypeptide containing a CoV-HKU1 polypeptide epitope, the antibodies resulting from administration of this polypeptide in vaccines which are also comprised of the various adjuvants.

The polypeptides may be formulated into the vaccine as neutral or salt forms. Pharmaceutically acceptable salts include the acid additional salts (formed with free amino groups of the peptide) and which are formed with inorganic acids, such as, for example, hydrochloric or phosphoric acids, or organic acids such as acetic, oxalic, tartaric, maleic, and the like. Salts formed with free carboxyl groups may also be derived from inorganic bases, such as, for example, sodium potassium, ammonium, calcium, or ferric hydroxides, and such organic bases as isopropylamine, trimethylamine, 2-ethylamino ethanol, histidine, procaine and the like.

The vaccines of the invention may be multivalent or univalent. Multivalent vaccines are made from recombinant viruses that direct the expression of more than one antigen.

Many methods may be used to introduce the vaccine formulations of the invention; these include but are not limited to oral, intradermal, intramuscular, intraperitoneal, intravenous, subcutaneous, intranasal routes, and via scarification (scratching through the top layers of skin, e.g., using a bifurcated needle).

The patient to which the vaccine is administered is preferably a mammal, most preferably a human, but can also be a non-human animal including but not limited to cows, horses, sheep, pigs, fowl (e.g., chickens), goats, cats, dogs, hamsters, mice and rats.

5.4 Preparation of Antibodies

Antibodies which specifically recognize a polypeptide of the invention, such as, but not limited to, polypeptides comprising the sequence of SEQ ID NO:2 or any of SEQ ID NOS: 34-2918, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and/or 2970-4236, or CoV-HKU1 epitope, or antigen-binding fragments thereof, can be used for detecting, screening, and isolating the polypeptide of the invention or fragments thereof, or similar sequences that might encode similar enzymes from the other organisms. For example, in one specific embodiment, an antibody which immunospecifically binds CoV-HKU1 epitope, or a fragment thereof, can be used for various in vitro detection assays, including enzyme-linked immunosorbent assays (ELISA), radioimmunoassays, Western blot, etc., for the detection of a polypeptide of the invention or, preferably, CoV-HKU1, in samples, for example, a biological material, including cells, cell culture media (e.g., bacterial cell culture media, mammalian cell culture media, insect cell culture media, yeast cell culture media, etc.), blood, plasma, serum, tissues, sputum, naseopharyngeal aspirates, etc.

Antibodies specific for a polypeptide of the invention or any epitope of CoV-HKU1 may be generated by any suitable method known in the art. Polyclonal antibodies to an antigen-of-interest, for example, the CoV-HKU1 epitopes or polypeptides encoded by a nucleotide sequence of SEQ ID NO:1 or 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, including the polypeptides shown in FIG. 2 (SEQ ID NOS: 34-1318), FIG. 3 (SEQ ID NOS:1319-2918), as well as SEQ ID NO:2, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and/or 2970-4236, can be produced by various procedures well known in the art. For example, an antigen can be administered to various host animals including, but not limited to, rabbits, mice, rats, etc., to induce the production of antisera containing polyclonal antibodies specific for the antigen. Various adjuvants may be used to increase the immunological response, depending on the host species, and include but are not limited to, Freund's (complete and incomplete) adjuvant, mineral gels such as aluminum hydroxide, surface active substances such as lysolecithin, pluronic polyols, polyanions, peptides, oil emulsions, keyhole limpet hemocyanins, dinitrophenol, and potentially useful adjuvants for humans such as BCG (Bacille Calnette-Guerin) and *Corynebacterium parvum*. Such adjuvants are also well known in the art (see Section 5.4, supra).

Monoclonal antibodies can be prepared using a wide variety of techniques known in the art including the use of hybridoma, recombinant, and phage display technologies, or a combination thereof. For example, monoclonal antibodies can be produced using hybridoma techniques including those known in the art and taught, for example, in Harlow et al., Antibodies: A Laboratory Manual, (Cold Spring Harbor Laboratory Press, 2nd ed. 1988); Hammerling, et al., in: Monoclonal Antibodies and T-Cell Hybridomas, pp. 563-681 (Elsevier, N.Y., 1981) (both of which are incorporated by reference in their entireties). The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced.

Methods for producing and screening for specific antibodies using hybridoma technology are routine and well known in the art. In a non-limiting example, mice can be immunized with an antigen of interest or a cell expressing such an antigen. Once an immune response is detected, e.g., antibodies specific for the antigen are detected in the mouse serum, the mouse spleen is harvested and splenocytes isolated. The splenocytes are then fused by well known techniques to any suitable myeloma cells. Hybridomas are selected and cloned by limiting dilution. The hybridoma clones are then assayed by methods known in the art for cells that secrete antibodies capable of binding the antigen. Ascites fluid, which generally contains high levels of antibodies, can be generated by inoculating mice intraperitoneally with positive hybridoma clones.

Antibody fragments which recognize specific epitopes may be generated by known techniques. For example, Fab and $F(ab')_2$ fragments may be produced by proteolytic cleavage of immunoglobulin molecules, using enzymes such as papain (to produce Fab fragments) or pepsin (to produce $F(ab')_2$ fragments). $F(ab')_2$ fragments contain the complete light chain, and the variable region, the CH1 region and the hinge region of the heavy chain.

The antibodies of the invention or fragments thereof can be also produced by any method known in the art for the synthesis of antibodies, in particular, by chemical synthesis or preferably, by recombinant expression techniques.

The nucleotide sequence encoding an antibody may be obtained from any information available to those skilled in the art (i.e., from Genbank, the literature, or by routine cloning and sequence analysis). If a clone containing a nucleic acid encoding a particular antibody or an epitope-binding fragment thereof is not available, but the sequence of the antibody molecule or epitope-binding fragment thereof is known, a nucleic acid encoding the immunoglobulin may be chemically synthesized or obtained from a suitable source (e.g., an antibody cDNA library, or a cDNA library generated from, or nucleic acid, preferably poly A+RNA, isolated from any tissue or cells expressing the antibody, such as hybridoma cells selected to express an antibody) by PCR amplification using synthetic primers hybridizable to the 3' and 5' ends of the sequence or by cloning using an oligonucleotide probe specific for the particular gene sequence to identify, e.g., a cDNA clone from a cDNA library that encodes the antibody. Amplified nucleic acids generated by PCR may then be cloned into replicable cloning vectors using any method well known in the art.

Once the nucleotide sequence of the antibody is determined, the nucleotide sequence of the antibody may be manipulated using methods well known in the art for the manipulation of nucleotide sequences, e.g., recombinant DNA techniques, site directed mutagenesis, PCR, etc. (see, for example, the techniques described in Sambrook et al., supra; and Ausubel et al., eds., 1998, Current Protocols in Molecular Biology, John Wiley & Sons, NY, which are both incorporated by reference herein in their entireties), to generate antibodies having a different amino acid sequence by, for example, introducing amino acid substitutions, deletions, and/or insertions into the epitope-binding domain regions of the antibodies or any portion of antibodies which may enhance or reduce biological activities of the antibodies.

Recombinant expression of an antibody requires construction of an expression vector containing a nucleotide sequence that encodes the antibody. Once a nucleotide sequence encoding an antibody molecule or a heavy or light chain of an antibody, or portion thereof has been obtained, the vector for the production of the antibody molecule may be produced by recombinant DNA technology using techniques well known in the art as discussed in the previous sections. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. The nucleotide sequence encoding the heavy-chain variable region, light-chain variable region, both the heavy-chain and light-chain variable regions, an epitope-binding fragment of the heavy- and/or light-chain variable region, or one or more complementarity determining regions (CDRs) of an antibody may be cloned into such a vector for expression. Thus-prepared expression vector can be then introduced into appropriate host cells for the expression of the antibody. Accordingly, the invention includes host cells containing a polynucleotide encoding an antibody specific for the polypeptides of the invention or fragments thereof.

The host cell may be co-transfected with two expression vectors of the invention, the first vector encoding a heavy chain derived polypeptide and the second vector encoding a light chain derived polypeptide. The two vectors may contain identical selectable markers which enable equal expression of heavy and light chain polypeptides or different selectable markers to ensure maintenance of both plasmids. Alternatively, a single vector may be used which encodes, and is capable of expressing, both heavy and light chain polypeptides. In such situations, the light chain should be placed before the heavy chain to avoid an excess of toxic free heavy chain (Proudfoot, Nature, 322:52, 1986; and Kohler, Proc. Natl. Acad. Sci. USA, 77:2 197, 1980). The coding sequences for the heavy and light chains may comprise cDNA or genomic DNA.

In another embodiment, antibodies can also be generated using various phage display methods known in the art. In phage display methods, functional antibody domains are displayed on the surface of phage particles which carry the polynucleotide sequences encoding them. In a particular embodiment, such phage can be utilized to display antigen binding domains, such as Fab and Fv or disulfide-bond stabilized Fv, expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage, including fd and M13. The antigen binding domains are expressed as a recombinantly fused protein to either the phage gene III or gene VIII protein. Examples of phage display methods that can be used to make the immunoglobulins, or fragments thereof, of the present invention include those disclosed in Brinkman et al., J. Immunol. Methods, 182:41-50, 1995; Ames et al., J. Immunol. Methods, 184: 177-186, 1995; Kettleborough et al., Eur. J. Immunol., 24:952-958, 1994; Persic et al., Gene, 187:9-18, 1997; Burton et al., Advances in Immunology, 57:191-280, 1994; PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

As described in the above references, after phage selection, the antibody coding regions from the phage can be isolated and used to generate whole antibodies, including human antibodies, or any other desired fragments, and expressed in any desired host, including mammalian cells, insect cells, plant cells, yeast, and bacteria, e.g., as described in detail below. For example, techniques to recombinantly produce Fab, Fab' and F(ab')2 fragments can also be employed using methods known in the art such as those disclosed in PCT publication WO 92/22324; Mullinax et al., BioTechniques, 12(6):864-869, 1992; and Sawai et al., AJRI, 34:26-34, 1995; and Better et al., Science, 240:1041-1043, 1988 (each of which is incorporated by reference in its entirety). Examples of techniques which can be used to produce single-chain Fvs and antibodies include those described in U.S. Pat. Nos. 4,946,778 and 5,258,498; Huston et al., Methods in Enzymology, 203:46-88, 1991; Shu et al., PNAS, 90:7995-7999, 1993; and Skerra et al., Science, 240:1038-1040, 1988.

Once an antibody molecule of the invention has been produced by any methods described above, it may then be purified by any method known in the art for purification of an immunoglobulin molecule, for example, by chromatography (e.g., ion exchange, affinity, particularly by affinity for the specific antigen after Protein A or Protein G purification, and sizing column chromatography), centrifugation, differential solubility, or by any other standard techniques for the purification of proteins. Further, the antibodies of the present invention or fragments thereof may be fused to heterologous polypeptide sequences described herein or otherwise known in the art to facilitate purification.

For some uses, including in vivo use of antibodies in humans and in vitro detection assays, it may be preferable to use chimeric, humanized, or human antibodies. A chimeric antibody is a molecule in which different portions of the antibody are derived from different animal species, such as antibodies having a variable region derived from a murine monoclonal antibody and a constant region derived from a human immunoglobulin. Methods for producing chimeric antibodies are known in the art. See e.g., Morrison, Science, 229:1202, 1985; Oi et al., BioTechniques, 4:214 1986; Gillies et al., J. Immunol. Methods, 125:191-202, 1989; U.S. Pat. Nos. 5,807,715; 4,816,567; and 4,816,397, which are incorporated herein by reference in their entireties. Humanized antibodies are antibody molecules from non-human species that bind the desired antigen having one or more complementarity determining regions (CDRs) from the non-human species and framework regions from a human immunoglobulin molecule. Often, framework residues in the human framework regions will be substituted with the corresponding residue from the CDR donor antibody to alter, preferably improve, antigen binding. These framework substitutions are identified by methods well known in the art, e.g., by modeling of the interactions of the CDR and framework residues to identify framework residues important for antigen binding and sequence comparison to identify unusual framework residues at particular positions. See, e.g., Queen et al., U.S. Pat. No. 5,585,089; Riechmann et al., Nature, 332:323, 1988, which are incorporated herein by reference in their entireties. Antibodies can be humanized using a variety of techniques known in the art including, for example, CDR-grafting (EP 239,400; PCT publication WO 91/09967; U.S. Pat. Nos. 5,225,539; 5,530,101 and 5,585,089), veneering or resurfacing (EP 592,106; EP 519,596; Padlan, Molecular Immunology, 28(4/5):489-498, 1991; Studnicka et al., Protein Engineering, 7(6):805-814, 1994; Roguska et al., Proc Natl. Acad. Sci. USA, 91:969-973, 1994), and chain shuffling (U.S. Pat. No. 5,565,332), all of which are hereby incorporated by reference in their entireties.

Completely human antibodies are particularly desirable for therapeutic treatment of human patients. Human antibodies can be made by a variety of methods known in the art including phage display methods described above using antibody libraries derived from human immunoglobulin sequences. See U.S. Pat. Nos. 4,444,887 and 4,716,111; and PCT publications WO 98/46645; WO 98/50433; WO 98/24893; WO 98/16654; WO 96/34096; WO 96/33735; and WO 91/10741, each of which is incorporated herein by reference in its entirety.

Human antibodies can also be produced using transgenic mice which are incapable of expressing functional endogenous immunoglobulins, but which can express human immunoglobulin genes. For an overview of this technology for producing human antibodies, see Lonberg and Huszar, Int. Rev. Immunol., 13:65-93, 1995. For a detailed discussion of this technology for producing human antibodies and human monoclonal antibodies and protocols for producing such antibodies, see, e.g., PCT publications WO 98/24893; WO 92/01047; WO 96/34096; WO 96/33735; European Patent No. 0 598 877; U.S. Pat. Nos. 5,413,923; 5,625,126; 5,633,425; 5,569,825; 5,661,016; 5,545,806; 5,814,318; 5,885,793; 5,916,771; and 5,939,598, which are incorporated by reference herein in their entireties. In addition, companies such as Abgenix, Inc. (Fremont, Calif.), Medarex (NJ) and Genpharm (San Jose, Calif.) can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a mouse antibody, is used to guide the selection of a completely human antibody recognizing the same epitope. (Jespers et al., Bio/technology, 12:899-903, 1988).

Antibodies fused or conjugated to heterologous polypeptides may be used in in vitro immunoassays and in purification methods (e.g., affinity chromatography) well known in the art. See e.g., PCT publication Number WO 93/21232; EP 439,095; Naramura et al., Immunol. Lett., 39:91-99, 1994; U.S. Pat. No. 5,474,981; Gillies et al., PNAS, 89:1428-1432, 1992; and Fell et al., J. Immunol., 146:2446-2452, 1991, which are incorporated herein by reference in their entireties.

Antibodies may also be attached to solid supports, which are particularly useful for immunoassays or purification of the polypeptides of the invention or fragments, derivatives, analogs, or variants thereof, or similar molecules having the similar enzymatic activities as the polypeptide of the invention. Such solid supports include, but are not limited to, glass, cellulose, polyacrylamide, nylon, polystyrene, polyvinyl chloride or polypropylene.

5.5 Pharmaceutical Compositions and Kits

The present invention encompasses pharmaceutical compositions comprising anti-viral agents of the present invention. In a specific embodiment, the anti-viral agent is an antibody which immunospecifically binds CoV-HKU1 or variants thereof, or any proteins derived therefrom. In another specific embodiment, the anti-viral agent is a polypeptide or nucleic acid molecule of the invention. The pharmaceutical compositions have utility as an anti-viral prophylactic agent and may be administered to a subject where the subject has been exposed or is expected to be exposed to a virus.

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu and Wu, 1987, J. Biol. Chem. 262:4429 4432). Methods of introduction include but are not limited to intradermal, intramuscular, intraperitoneal, intravenous, subcutaneous, intranasal, epidural, and oral routes. The compounds may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. In a preferred embodiment, it may be desirable to introduce the pharmaceutical compositions of the invention into the lungs by any suitable route. Pulmonary administration can also be employed, e.g., by use of an inhaler or nebulizer, and formulation with an aerosolizing agent.

In a specific embodiment, it may be desirable to administer the pharmaceutical compositions of the invention locally to the area in need of treatment; this may be achieved by, for example, and not by way of limitation, local infusion during surgery, topical application, e.g., in conjunction with a wound dressing after surgery, by injection, by means of a catheter, by means of a suppository, by means of nasal spray, or by means of an implant, said implant being of a porous, non porous, or gelatinous material, including membranes, such as sialastic membranes, or fibers. In one embodiment, administration can be by direct injection at the site (or former site) infected tissues.

In another embodiment, the pharmaceutical composition can be delivered in a vesicle, in particular a liposome (see Langer, 1990, Science 249:1527-1533; Treat et al., in Liposomes in the Therapy of Infectious Disease and Cancer, Lopez Berestein and Fidler (eds.), Liss, New York, pp. 353-365 (1989); Lopez-Berestein, ibid. , pp. 317-327; see generally ibid.).

In yet another embodiment, the pharmaceutical composition can be delivered in a controlled release system. In one embodiment, a pump may be used (see Langer, supra; Sefton, 1987, CRC Crit. Ref. Biomed. Eng. 14:201; Buchwald et al.,1980, Surgery 88:507; and Saudek et al., 1989, N. Engl. J. Med. 321:574). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, J. Macromol. Sci. Rev. Macromol. Chem. 23:61 (1983); see also Levy et al., 1985, Science 228:190; During et al., 1989, Ann. Neurol. 25:351; Howard et al., 1989, J. Neurosurg. 71:105). In yet another embodiment, a controlled release system can be placed in proximity of the composition's target, i.e., the lung, thus requiring only a fraction of the systemic dose (see, e.g., Goodson, in Medical Applications of Controlled Release, supra, vol. 2, pp. 115-138 (1984)).

Other controlled release systems are discussed in the review by Langer (Science 249:1527-1533 (1990)).

The pharmaceutical compositions of the present invention comprise a therapeutically effective amount of recombinant or chimeric CoV-HKU1, and a pharmaceutically acceptable carrier. In a specific embodiment, the term "pharmaceutically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the pharmaceutical composition is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E. W. Martin. The formulation should suit the mode of administration.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

The pharmaceutical compositions of the invention can be formulated as neutral or salt forms. Pharmaceutically acceptable salts include those formed with free amino groups such as those derived from hydrochloric, phosphoric, acetic, oxalic, tartaric acids, etc., and those formed with free carboxyl groups such as those derived from sodium, potassium, ammonium, calcium, ferric hydroxides, isopropylamine, triethylamine, 2 ethylamino ethanol, histidine, procaine, etc.

The amount of the pharmaceutical composition of the invention which will be effective in the treatment of a particular disorder or condition will depend on the nature of the disorder or condition, and can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. However, suitable dosage ranges for intravenous administration are generally about 20-500 micrograms of active compound per kilogram body weight. Suitable dosage ranges for intranasal administration are generally about 0.01 pg/kg body weight to 1 mg/kg body weight. Effective doses may be extrapolated from dose response curves derived from in vitro or animal model test systems.

Suppositories generally contain active ingredient in the range of 0.5% to 10% by weight; oral formulations preferably contain 10% to 95% active ingredient.

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use or sale for human administration. In a preferred embodiment, the kit contains an antiviral agent of the invention, e.g., an antibody specific for the polypeptides encoded by a nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966 or any CoV-HKU1 epitope, or a polypeptide or protein of the present invention, including those shown in FIG. 2 (SEQ ID NOS:34-1318), FIG. 3 (SEQ ID NOS:1319-2918), FIG. 9 (SEQ ID NOS:2970-4236) and SEQ ID NO:2, or a nucleic acid molecule of the invention, alone or in combination with adjuvants, antivirals, antibiotics, analgesic, bronchodialaters, or other pharmaceutically acceptable excipients.

The present invention further encompasses kits comprising a container containing a pharmaceutical composition of the present invention and instructions for use.

5.6 Detection Assays

The present invention provides a method for detecting an antibody, which immunospecifically binds to the CoV-HKU1, in a biological sample, for example blood, serum, plasma, saliva, urine, etc., from a patient suffering from respiratory tract infection. In a specific embodiment, the method comprising contacting the sample with the polypeptides or protein encoded by the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, including the polypeptides having the amino acid sequences of SEQ ID NOS:34-1318 shown in FIG. 2, SEQ ID NOS:1319-2918 shown in FIG. 3, or SEQ ID NO:2, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, and/or 2970-4236 shown in FIG. 9, directly immobilized on a substrate and detecting the virus-bound antibody directly or indirectly by a labeled heterologous anti-isotype antibody. In another specific embodiment, the sample is contacted with a host cell comprising a nucleic acid molecule having the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, and expressing the polypeptides encoded thereby, and the bound antibody can be detected by immunofluorescent assay.

An exemplary method for detecting the presence or absence of a polypeptide or nucleic acid of the invention in a biological sample involves obtaining a biological sample from various sources and contacting the sample with a compound or an agent capable of detecting an epitope or nucleic acid (e.g., mRNA, genomic RNA) of CoV-HKU1 such that the presence of CoV-HKU1 is detected in the sample. A preferred agent for detecting CoV-HKU1 mRNA or genomic RNA of the invention is a labeled nucleic acid probe capable of hybridizing to mRNA or genomic RNA encoding a polypeptide of the invention. The nucleic acid probe can be, for example, a nucleic acid molecule comprising or consisting of the nucleotide sequence of SEQ ID NO:1, 3, 2919, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966, or a portion thereof, or a complement thereof, such as an oligonucleotide of at least 15, 20, 25, 30, 50, 100, 250, 500, 750, 1,000 or more contiguous nucleotides in length and sufficient to specifically hybridize under stringent conditions to a CoV-HKU1 mRNA or genomic RNA.

In another preferred specific embodiment, the presence of CoV-HKU1 is detected in the sample by an reverse transcription polymerase chain reaction (RT-PCR) using the primers that are constructed based on a partial nucleotide sequence of the genome of CoV-HKU1 or a genomic nucleic acid sequence of SEQ ID NO:3 or 2919, or based on a nucleotide sequence of SEQ ID NO:1, 2920, 2922, 2924, 2926, 2928, 2930, 2932, 2934, 2936, 2938, 2940, 2942, 2944, 2946, 2948, 2950, 2952, 2954, 2956, 2958, 2960, 2962, 2964 and/or 2966. In a non-limiting specific embodiment, preferred primers to be used in a RT-PCR method are: 5'-GGTTGGGACTATCCTAAGTGTGA-3' (SEQ ID NO:4) and 5'-CCATCATCAGATAGAATCATCATA-3' (SEQ ID NO:5), or 5'-AAAGGATGTTGACAACCCTGTT-3' (LPW1926; SEQ ID NO: 2968) and 5'-ATCATCATACTAAAATGCTTACA-3' (LPW1927; SEQ ID NO: 2969), in the presence of 3 mM $MgCl_2$ and the thermal cycles are, for example, but not limited to, 94° C. for 8 min followed by 40 cycles of 94° C. for 1 min, 50° C. for 1 min, 72° C. for 1 min. In more preferred specific embodiment, the present invention provides a real-time quantitative PCR assay to detect the presence of CoV-HKU1 in a biological sample by subjecting the cDNA obtained by reverse transcription of the extracted total RNA from the sample to PCR reactions using the specific primers, such as those having nucleotide sequences of SEQ ID NOS:4, 5, 2968 and 2969, and a fluorescence dye, such as SYBR® Green I, which fluoresces when bound non-specifically to double-stranded DNA. The fluorescence signals from these reactions are captured at the end of extension steps as PCR product is generated over a range of the thermal cycles, thereby allowing the quantitative determination of the viral load in the sample based on an amplification plot.

A preferred agent for detecting CoV-HKU1 is an antibody that specifically binds a polypeptide of the invention or any CoV-HKU1 epitope, preferably an antibody with a detectable label. Antibodies can be polyclonal, or more preferably, monoclonal. An intact antibody, or a fragment thereof (e.g., Fab or $F(ab')_2$) can be used.

The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin. The detection method of the invention can be used to detect mRNA, protein (or any epitope), or genomic RNA in a sample in vitro as well as in vivo. For example, in vitro techniques for detection of mRNA include northern hybridizations, in situ hybridizations, RT-PCR, and RNase protection. In vitro techniques for detection of an epitope of CoV-HKU1 include enzyme linked immunosorbent assays (ELISAs), Western blots, immunoprecipitations and immunofluorescence. In vitro techniques for detection of genomic RNA include northern hybridizations, RT-PCR, and RNase protection. Furthermore, in vivo techniques for detection of CoV-HKU1 include introducing into a subject organism a labeled antibody directed against the polypeptide. For example, the antibody can be labeled with a radioactive marker whose presence and location in the subject organism can be detected by standard imaging techniques, including autoradiography.

In a specific embodiment, the methods further involve obtaining a control sample from a control subject, contacting the control sample with a compound or agent capable of detecting CoV-HKU1, e.g., a polypeptide of the invention or mRNA or genomic RNA encoding a polypeptide of the invention, such that the presence of CoV-HKU1 or the polypeptide or mRNA or genomic RNA encoding the polypeptide is detected in the sample, and comparing the absence of CoV-HKU1 or the polypeptide or mRNA or genomic RNA encoding the polypeptide in the control sample with the presence of CoV-HKU1, or the polypeptide or mRNA or genomic DNA encoding the polypeptide in the test sample.

The invention also encompasses kits for detecting the presence of CoV-HKU1 or a polypeptide or nucleic acid of the invention in a test sample. The kit, for example, can comprise a labeled compound or agent capable of detecting CoV-HKU1 or the polypeptide or a nucleic acid molecule encoding the polypeptide in a test sample and, in certain embodiments, a means for determining the amount of the polypeptide or mRNA in the sample (e.g., an antibody which binds the polypeptide or an oligonucleotide probe which binds to DNA or mRNA encoding the polypeptide). Kits can also include instructions for use.

For antibody-based kits, the kit can comprise, for example: (1) a first antibody (e.g., attached to a solid support) which binds to a polypeptide of the invention or CoV-HKU1 epitope; and, optionally, (2) a second, different antibody which binds to either the polypeptide or the first antibody and is conjugated to a detectable agent.

For oligonucleotide-based kits, the kit can comprise, for example: (1) an oligonucleotide, e.g., a detectably labeled oligonucleotide, which hybridizes to a nucleic acid sequence encoding a polypeptide of the invention or to a sequence within the CoV-HKU1 genome or (2) a pair of primers useful for amplifying a nucleic acid molecule containing an CoV-HKU1 sequence. The kit can also comprise, e.g., a buffering agent, a preservative, or a protein stabilizing agent. The kit can also comprise components necessary for detecting the detectable agent (e.g., an enzyme or a substrate). The kit can also contain a control sample or a series of control samples which can be assayed and compared to the test sample contained. Each component of the kit is usually enclosed within an individual container and all of the various containers are within a single package along with instructions for use.

6. EXAMPLES

The following examples illustrate the identification of the novel CoV-HKU1. These examples should not be construed as limiting.

METHODS AND RESULTS

As a general reference, Wiedbrauk D L & Johnston S L G. (Manual of Clinical Virology, Raven Press, New York, 1993) was used.

6.1 Example 1

6.1.1 Clinical Subject

The patient is an in-patient of the United Christian Hospital in Hong Kong. Nasopharyngeal aspirates were collected from the patient weekly from the first till the fifth week of the illness, stool and urine in the first and second week of the illness, and sera in the first, second, and fourth weeks of the illness.

6.1.2 Antibody Detection

To produce a fusion plasmid for protein purification, primers, 5'-TTTTCCTTTTGCGGCCGCTTAAGCAACA-GAGTCTTCTA-3' (SEQ ID NO:6) and 5'-CGGAATTC-GATGTCTTATACTCCCGGT-3'(SEQ ID NO:7) were used to amplify the gene encoding the N protein of the CoV-HKU1 by RT-PCR. The sequence coding for amino acid residues 1 to 441 of the N protein was amplified and cloned into the EcoRI and NotI sites of expression vector pET-28b (+) (Novagen, Madison, Wis., USA) in frame and downstream of the series of six histidine residues. The $(His)_6$-tagged (SEQ ID NO:27) recombinant N protein was expressed in *E. coli* and purified using the $Ni^{2+}$-loaded HiTrap Chelating System (Amersham Pharmacia, USA) according to the manufacturer's instructions.

Western blot analysis was performed as follows: Two-hundred ng of purified $(His)_6$-tagged (SEQ ID NO:27) recombinant N protein of CoV-HKU1 were loaded into each well of a sodium dodecyl sulfate (SDS)—10% polyacrylamide gel and subsequently electroblotted onto a nitrocellulose membrane (Bio-Rad, Hercules, Calif., USA). The blot was cut into strips and the strips were incubated separately with 1:2000 dilution of serum samples obtained during the first, second, and fourth weeks of the patient's illness. Serum samples of two healthy blood donors were used as controls. Antigen-antibody interaction was detected with an ECL fluorescence system (Amersham Life Science, Buckinghamshire, UK).

Several prominent immunoreactive bands were visible for serum samples collected during the second and fourth weeks of the patient's illness (FIG. 8, lanes 2 and 3). The sizes of the largest bands were about 53 kDa, consistent with the expected size of 52.8 kDa for the full-length $(His)_6$-tagged (SEQ ID NO:27) N protein, whereas the other bands were consistent with the degradation products of the $(His)_6$-tagged (SEQ ID NO:27) N protein. Only very faint bands were observed for serum samples obtained from the patient during the first week of the illness (FIG. 8, lane 1) and two healthy blood donors (FIG. 8, lanes 4 and 5).

ELISA was performed using the recombinant N protein of CoV-HKU1 prepared as described above. Each well of a Nunc immunoplate (Roskilde, Denmark) was coated with 20 ng of purified $(His)_6$-tagged (SEQ ID NO:27) recombinant N protein for 12 h and then blocked in phosphate-buffered saline with 2% bovine serum albumin. The serum samples obtained from the patient during the first, second, and fourth weeks of the illness were serially diluted and were added to the wells of the (His)6-tagged (SEQ ID NO:27) recombinant N protein-coated plates in a total volume of 100 μl per well and incubated at 37° C. for 2 h. After washing with washing buffer five times, 100 μl per well of 1:4000 diluted horse radish peroxidase-conjugated goat anti-human IgG antibody (Zymed Laboratories Inc., South San Francisco, Calif., USA) were added to the wells and incubated at 37° C. for 1 h. After washing with washing buffer five times, 100 μl of diluted 3,3',5,5'-tetramethylbenzidine (Zymed Laboratories Inc.) were added to each well and incubated at room temperature for 15 min. One hundred microliters of 0.3 M $H_2SO_4$ were added and the absorbance at 450 nm of each well was measured. Each sample was tested in duplicate and the mean absorbance for each serum was calculated.

Box titration was carried out with different dilutions of $(His)_6$-tagged (SEQ ID NO:27) recombinant N protein coating antigen and serum obtained from the fourth week of the patient's illness. The results identified 20 ng and 80 ng of purified $(His)_6$-tagged recombinant N protein per ELISA well as the ideal amount for plate coating and 1:1000 and 1:20 as the most optimal serum dilution for IgG and IgM detection, respectively.

To establish the baseline for the tests, serum samples (diluted at 1:1000 and 1:20 for IgG and IgM, respectively) from 100 healthy blood donors were tested in the CoV-HKU1 antibody ELISA. For the 100 sera from healthy blood donors, the mean ELISA $OD_{450}$ values for IgG and IgM detection were 0.178 and 0.224, with standard deviations of 0.070 and 0.117. Absorbance values of 0.387 and 0.576 were selected as the cutoff values (that equal the sum of the mean value from the healthy control and three times the standard deviation) for IgG and IgM, respectively. Using these cutoff values, the titers for IgG of the patient's serum samples obtained during the first, second, and fourth weeks of the illness were<1:1000, 1:2000, and 1:8000, respectively (FIG. 7), and those for IgM were 1:20, 1:40, and 1:80, respectively (data not shown).

6.1.3 RT-PCR and Real Time Quantitative PCR

RT-PCR Assay

An RT-PCR was developed to detect the CoV-HKU1 sequence from NPA samples. Total RNA from clinical samples was reverse transcribed using random hexamers and cDNA was amplified using primers 5'-GGTTGGGACTATCCTAAGTGTGA-3' (SEQ ID NO:4) and 5'-CCATCATCAGATAGAATCATCATA-3' (SEQ ID NO:5), which were constructed based on the RNA-dependent RNA polymerase-encoding sequence (SEQ ID NO:1) of the CoV-HKU1 in the presence of 2.5 mM $MgCl_2$ (94° C. for 8 min followed by 40 cycles of 94° C. for 1 min, 50° C. for 1 min, 72° C. for 1 min).

The summary of a typical RT-PCR protocol is as follows:

1. RNA Extraction

RNA from 140 μl of NPA samples was extracted by QIAquick® viral RNA extraction kit and was eluted in 50 μl of elution buffer.

2. Reverse Transcription

| | |
|---|---|
| RNA | 11.5 μl |
| 0.1 M DTT | 2 μl |
| 5 × buffer | 4 μl |
| 10 mM dNTP | 1 μl |
| Superscript II, 200 U/μl (Invitrogen) | 1 μl |
| Random hexamers, 0.3 μg/μl | 0.5 μl |
| Reaction condition | 42° C., 50 min<br>94° C., 3 min<br>4° C. |

3. PCR cDNA generated by random primers was amplified in a 50 μl reaction as follows:

| | |
|---|---|
| cDNA | 2 μl |
| 10 mM dNTP | 0.5 μl |
| 10 × buffer | 5 μl |
| 25 mM $MgCl_2$ | 5 μl |
| 25 μM Forward primer | 0.5 μl |
| 25 μM Reverse primer | 0.5 μl |
| AmpliTaq Gold ® polymerase, 5 U/μl (Applied Biosystems) | 0.25 μl |
| Water | 36.25 μl |

Thermal-cycle condition: 95° C., 10 min, followed by 40 cycles of 95° C., 1 min; 50° C. 1 min; 72° C., 1 min.

4. Primer Sequences

Primers were designed based on the RNA-dependent RNA polymerase encoding sequence (SEQ ID NO:1) of the CoV-HKU1.

```
Forward primer:
5'-GGTTGGGACTATCCTAAGTGTGA-3'      (SEQ ID NO: 4)

Reverse primer: and
5'-CCATCATCAGATAGAATCATCATA-3'     (SEQ ID NO: 5)

Product size:
440 bps
```

Real-Time Quantitative PCR Assay

Total RNA from 140 μl of nasopharyngeal aspirate (NPA) was extracted by QIAamp® virus RNA mini kit (Qiagen) as instructed by the manufacturer. Ten μl of eluted RNA samples were reverse transcribed by 200 U of Superscript® II reverse transcriptase (Invitrogen) in a 20 μl reaction mixture containing 0.15 µg of random hexamers, 10 mmol/L DTT, and 0.5 mmol/L dNTP, as instructed. Complementary DNA was then amplified in a SYBR® Green I fluorescence reaction (Roche, Ind.) mixtures. Briefly, 20 µl reaction mixtures containing 2 µl of cDNA, 3.5 mmol/L $MgCl_2$, 0.25 µmol/L of forward primer [5'-GGTTGGGACTATCCTAAGTGTGA-3' (SEQ ID NO:4)] and 0.25 µmol/L reverse primer [5'-CCATCATCAGATAGAATCATCATA-3' (SEQ ID NO:5)] were thermal-cycled by a LightCycler® (Roche) with the PCR program, [95° C., 10 min followed by 50 cycles of 95° C., 10 min; 57° C., 5 sec; 72° C. 9 sec]. Plasmids containing the target sequence were used as positive controls. Fluorescence signals from these reactions were captured at the end of extension step in each cycle. To determine the specificity of the assay, PCR products (440 base pairs) were subjected to a melting curve analysis at the end of the assay (65° C. to 95° C., 0.1° C. per second) (data not shown).

The amount of CoV-HKU1 RNA in the nasopharyngeal aspirates was followed weekly. Quantitative RT-PCR showed that the amounts of CoV-HKU1 RNA were $8.5\times10^5$ and $9.6\times10^6$ copies per ml in two nasopharyngeal aspirates collected in the first week of the illness, 1.5x105 copies per ml of NPA, respectively, at two time points collected in the second week of the illness, but CoV-HKU1 RNA was undetectable in the NPA collected in the third, fourth and fifth weeks of the illness (FIG. 7). CoV-HKU1 RNA was also undetectable in the urine and stool of the patient collected in the first and second weeks of the illness.

Discussion

The genome of CoV-HKU1 is a 29926-nucleotide long, polyadenylated RNA. The G+C content is 32%, which is the lowest among all known coronaviruses with genome sequences available, with a GC skew of 0.19. Table 1 shows comparison of genomic features of CoV-HKU1 and other coronaviruses and amino acid identities between the predicted chymotrypsin-like protease ($3CL^{pro}$), RNA dependent RNA polymerase (Pol), helicase (Hel), hemagglutinin-esterase (HE), spike (S), envelope (E), membrane (M), and nucleocapsid (N) proteins of CoV-HKU1 and the corresponding proteins of other coronaviruses

TABLE 1

| | Genome features | | Pairwise amino acid identity (%) | | | | | | | |
|---|---|---|---|---|---|---|---|---|---|---|
| Coronaviruses[a] | Size (bases) | G + C content | $3CL^{pro}$ | Pol | Hel | HE | S | E | M | N |
| Group 1 | | | | | | | | | | |
| HCoV-229E | 27317 | 0.38 | 45 | 54 | 55 | — | 31 | 26 | 35 | 28 |
| PEDV | 28033 | 0.42 | 44 | 56 | 55 | — | 30 | 34 | 37 | 37 |
| PTGV | 28586 | 0.38 | 45 | 57 | 57 | — | 32 | 34 | 37 | 27 |
| CCoV | — | — | — | — | — | — | 31 | 32 | 36 | 27 |
| HCoV-NL63 | 27553 | 0.34 | 43 | 54 | 54 | — | 30 | 28 | 32 | 28 |
| Group 2 | | | | | | | | | | |
| CoV-HKU1 | 29926 | 0.32 | — | — | — | — | — | — | — | — |
| HCoV-OC43 | 30738 | 0.37 | 82 | 87 | 88 | 57 | 60 | 54 | 76 | 58 |
| MHV | 31357 | 0.42 | 85 | 90 | 89 | 50 | 61 | 57 | 84 | 68 |
| BCoV | 31028 | 0.37 | 84 | 88 | 88 | 56 | 61 | 55 | 76 | 57 |
| SDAV | — | — | — | — | — | 50 | 61 | 60 | 77 | 62 |
| ECoV | — | — | — | — | — | 53 | 61 | 56 | 78 | 59 |
| PHEV | — | — | — | — | — | 54 | 61 | 54 | 77 | 57 |
| Group 3 | | | | | | | | | | |
| IBV | 27608 | 0.38 | 41 | 60 | 57 | — | 32 | 28 | 38 | 27 |
| SARS-CoV | 29751 | 0.41 | 48 | 65 | 63 | — | 33 | 27 | 34 | 31 |

[a]HCoV-229E, human coronavirus 229E; PEDV, porcine epidemic diarrhea virus; PTGV, porcine transmissible gastroenteritis virus; CCoV, canine enteric coronavirus; HCoV-NL63, human coronavirus NL63; HCoV-OC43, human coronavirus OC43; MHV, murine hepatitis virus;BCoV, bovine coronavirus; SDAV, rat sialodacryoadenitis coronavirus; ECoV, equine coronavirus NC99; PHEV, porcine hemagglutinating encephalomyelitis virus; IBV, infectious bronchitis virus; SARS-CoV, SARS coronavirus The genome organization is the same as other coronaviruses, with the characteristic gene order 5'-replicase, S, E, M, N-3'. Both 5' and 3' ends contain short untranslated regions. The 5' end of the genome consists of a putative 5' leader sequence. A putative transcription regulatory sequences (TRS) motif, 5'-CUAAAC-3', was found at the 3' end of the leader sequence and precedes each translated ORF except ORF5 which encodes the putative E protein. Table 2 shows the putative transcription regulatory sequences in the genome of CoV-HKU1.

TABLE 2

| Number of base up-stream of AUG | ORF | TRS sequence | SEQ ID NO. |
|---|---|---|---|
| -140 | Leader | UUAAAUCUAAACUUUUUAA (127) **AUG** | 8 |
| -7 | Hemagglutinin esterase | UUAAAUCUAAACU **AUG** | 9 |
| -6 | Spike | UUAAAUCUAAAC **AUG** | 10 |
| -13 | ORF 4 | UUAAAUCUAAACUUUAUUU **AUG** | 11 |
| -9 | Membrane | CUAAAUCUAAACAUU **AUG** | 12 |
| -13 | Nucleocapsid | UUAAAUCUAAACUAUUAGG **AUG** | 13 |

TABLE 2-continued

| Number of base up-stream of AUG | ORF | TRS sequence | SEQ ID NO. |
|---|---|---|---|
| -35 | ORF 8 | UUAAAUCUAAACUAUUAGGAUGUCUUAU ACUCCCGGUCAUU **AUG** | 14 |

As in SDAV (Sialodacryoadenitis virus) and MHV (mouse hepatitis virus), ORF5 may share the same TRS with ORF 4, suggesting that the translation of the E protein is cap-independent, possibly via an internal ribosomal entry site. The 3' untranslated region contains a predicted pseudoknot structure 59-119 bp downstream of N gene. This pseudoknot structure is highly conserved among coronaviruses and plays a role in coronavirus RNA replication.

The coding potential of the CoV-HKU1 genome is shown in FIG. 4 and Table 3 and the phylogenetic analyses of the chymotrypsin-like protease (3CL$^{pro}$), replicase, helicase, haemagglutinin-esterase (HE), S, E, M and N, are shown in FIGS. 5A and 5B.

TABLE 3

| ORFs | Start-end (base) | No. of bases | No. of amino acids | Frame | Candidate TRS |
|---|---|---|---|---|---|
| ORF 1a | 206-13600 | 13395 | 4465 | +2 | — |
| ORF 1b | 13600-21753 | 8154 | 2717 | +1 | — |
| HE (ORF 2) | 21773-22933 | 1161 | 386 | +2 | Strong |
| S (ORF 3) | 22942-27012 | 4071 | 1356 | +1 | Strong |
| ORF 4 | 27051-27380 | 330 | 109 | +3 | Strong |
| E (ORF 5) | 27373-27621 | 249 | 82 | +1 | None |
| M (ORF 6) | 27633-28304 | 672 | 223 | +3 | Strong |
| N (ORF 7) | 28320-29645 | 1326 | 441 | +3 | Strong |
| ORF 8 | 28342-28959 | 618 | 205 | +1 | Strong |

The replicase 1a ORF (bases 206-13600) and replicase 1b ORF (bases 13600-21753) occupy 21.5 kb of the CoV-HKU1 genome. Similar to other coronaviruses, a frame shift interrupts the protein-coding regions and separates the 1a and 1b ORFs. This ORF encodes a number of putative proteins, including papain-like protease (PLP) with two copies of the PLP domain, PLP1$^{pro}$ and PLP2$^{pro}$, 3CL$^{pro}$, replicase, helicase, and other proteins of unknown functions. These proteins are produced by proteolytic cleavages of a large polyprotein (FIG. 4). The sequence of the resulting putative proteins is the same as that in the MHV genome. This polyprotein is synthesized by a −1 ribosomal frameshift at a conserved site (UUUAAAC) upstream of a pseudoknot structure at the junction of ORF 1 a and ORF 1b. This ribosomal frameshift would result in a polyprotein of 7182 amino acids, which has 75-77% amino acid identities with the polyprotein in other Group 2 coronaviruses and 43-47% amino acid identities with the polyprotein in other non-Group 2 coronaviruses. The replicase gene of CoV-HKU1, which encodes 928 amino acids, has 87-89% amino acid identities with the replicase of other Group 2 coronaviruses and 54-65% amino acid identities with the replicase of other non-Group 2 coronaviruses (Table 4 and FIG. 5A). Table 4 shows amino acid identities between the predicted chymotrypsin-like protease (3CL$^{pro}$), replicase (Rep), helicase (Hel), hemagglutinin-esterase (HE), spike (S), envelope (E), membrane (M), and nucleocapsid (N) proteins of CoV-HKU1 and the corresponding proteins of other coronaviruses.

TABLE 4

| | | Pairwise amino acid identity (%) | | | | | | | |
|---|---|---|---|---|---|---|---|---|---|
| Group | Virus | 3CL$^{pro}$ | Rep | Hel | HE | S | E | M | N |
| 1 | HCoV-229E | 45 | 54 | 55 | — | 31 | 26 | 35 | 28 |
| | PEDV | 44 | 56 | 55 | — | 30 | 34 | 37 | 37 |
| | PTGV | 45 | 57 | 57 | — | 32 | 34 | 37 | 27 |
| | CCoV | — | — | — | — | 31 | 32 | 36 | 27 |
| | HCoV-NL63 | 43 | 54 | 54 | — | 30 | 28 | 32 | 28 |
| 2 | HCoV-OC43 | 82 | 87 | 88 | 57 | 60 | 54 | 76 | 58 |
| | MHV | 85 | 89 | 87 | 50 | 58 | 55 | 78 | 60 |
| | BCoV | 84 | 88 | 88 | 56 | 61 | 55 | 76 | 57 |
| | SDAV | — | — | — | 50 | 61 | 60 | 77 | 62 |
| | ECoV | — | — | — | 53 | 61 | 56 | 78 | 59 |
| | PHEV | — | — | — | 54 | 61 | 54 | 77 | 57 |
| 3 | IBV | 41 | 60 | 57 | — | 32 | 28 | 38 | 27 |
| SARS-CoV | SARS-CoV | 48 | 65 | 63 | — | 33 | 27 | 34 | 31 |

HCoV-229E = human coronavirus 229E;
PEDV = porcine epidemic diarrhea virus;
PTGV = porcine transmissible gastroenteritis virus;
CCoV = canine enteric coronavirus;
HCoV-NL63 = human coronavirus NL63;
HCoV-OC43 = human coronavirus OC43;
MHV = murine hepatitis virus;
BCoV = bovine coronavirus;
SDAV = rat sialodacryoadenitis coronavirus;
ECoV = equine coronavirus NC99;
PHEV = porcine hemagglutinating encephalomyelitis virus;
IBV = infectious bronchitis virus;
SARS-CoV = SARS coronavirus The catalytic histidine and cysteine amino acid residues, conserved among the 3CL$^{pro}$ in all coronaviruses, are present in the predicted 3CL$^{pro}$ of CoV-HKU1 (amino acids His$^{3375}$ and Cys$^{3479}$ of ORF 1a). In the N-terminal of the putative PLP (amino acid residues 945 to 1104 of ORF 1a), there are 14 tandem copies of a 30-base repeat, which encode NDDEDVVTGD (SEQ ID NO:15), followed by two 30-base regions that encode NNDEEIVTGD (SEQ ID NO:16) and NDDQIVVTGD (SEQ ID NO:17), located upstream to the first copy of PLP domain, PLP1$^{pro}$. This repeat is not observed in other coronaviruses.

ORF 2 (bases 21773-22933) encodes the predicted HE glycoprotein with 386 amino acids. The HE protein of CoV-HKU1 has 50-57% amino acid identities with the HE proteins of other Group 2 coronaviruses (Table 4 and FIG. 5A). PFAM and InterProScan analyses of the ORF show that amino acid residues 1 to 349 of the predicted protein is a member of the haemagglutinin esterase family (PFAM accession no.: PF03996 and INTERPRO accession no. IPR007142). This family contains membrane glycoproteins that are present on viral surface and are involved with the cell infection process. It contains haemagglutinin chain 1 (HE1) and haemagglutinin chain 2 (HE2), and forms a homotrimer with each monomer being formed by two chains linked by a disulphide bond. Furthermore, PFAM and InterProScan analyses of the ORF show that amino acid residues 122 to 236 of the predicted protein are the haemagglutinin domain of HE-fusion glycoprotein family (PFAM accession no.: PF02710 and INTERPRO accession no. IPR003860). HE is also present in other Group 2 coronaviruses and influenza C virus. SignalP analysis reveals a signal peptide probability of 0.738, with a cleavage site between residues 13 and 14. Although TMpred and TMHMM analyses of the ORF show four and three transmembrane domains, respectively, PHDhtm analysis of the ORF shows only one transmembrane domain at positions 354 to 376. This concurs with only one transmembrane region reported in the C terminal of the HE of BCoV (bovine coronavirus) and puffinosis virus. PrositeScan analysis of the HE protein of CoV-HKU1 reveals eight potential N-linked glycosylation (six NXS and two NXT) sites. These are located at positions 83 (NYT), 110, (NGS), 145 (NVS), 168 (NYS), 193 (NFS), 286 (NSS), 314 (NVS, and 328 (NFT). The putative active site for neuraminate O-acetyl-esterase activity, FGDS (SEQ ID NO:18), is located at positions 31-34.

ORF 3 (bases 22942-27012) encodes the predicted S glycoprotein (PFAM accession no. PF01601) with 1356 amino acids. The S protein of CoV-HKU1 has 58-61% amino acid identities with the S proteins of other Group 2 coronaviruses, but has fewer than 35% amino acid identities with the S proteins of Group 1, Group 3, and SARS-CoV (Table 4 and FIG. 5B). InterProScan analysis predicts it as a type I membrane glycoprotein. Important features of the S protein of CoV-HKU1 are depicted in FIG. 6. PrositeScan of the S protein of CoV-HKU1 reveals 28 potential N-linked glycosylation (12 NXS and 16 NXT) sites. SignalP analysis reveals a signal peptide probability of 0.909, with a cleavage site between residues 13 and 14. By multiple alignments with the S proteins of other Group 2 coronaviruses, a potential cleavage site located after RRKRR (SEQ ID NO:19), between residues 760 and 761, where S will be cleaved into S1 and S2, is identified. Immediately upstream to RRKRR (SEQ ID NO:19), there is a series of five serine residues that are not present in any other known coronaviruses (FIG. 6). Most of the S protein (residues 15 to 1300) is exposed on the outside of the virus, with a transmembrane domain at the C terminus (TMHMM analysis of the ORF shows one transmembrane domain at positions 1301 to 1356), followed by a cytoplasmic tail rich in cysteine residues. Two heptad repeats (HR), located at residues 982 to 1083 (HR1) and 1250 to 1297 (HR2), identified by multiple alignments with other coronaviruses, are present. In MHV, it has been confirmed that the receptor for its S protein binding is CEACAMI, a member of the carcinoembryonic antigen (CEA) family of glycoproteins in the immunoglobulin superfamily. Furthermore, it has been shown, by site-directed mutagenesis, that three conserved regions (sites I, II, and III) and some amino acid residues ($Thr^{62}$, $Thr^{212}$, $Tyr^{214}$, and $Tyr^{216}$ in MHV) in the N-terminal of the S protein are particularly important for its receptor-binding activity. By multiple alignments with the N-terminal 330 amino acids of the S protein of MHV and other group 2 coronaviruses, it is observed that these conserved regions and amino acids are present in CoV-HKU1 (FIG. 6). This infers that the receptor for CoV-HKU1 could be a member of the CEA family on the surface of the cells in the respiratory tract. On the other hand, for HCoV-OC43, it has been shown in vitro that the receptor for the S protein is a sialic acid. However, the amino acid residues on the S protein of HCoV-OC43 that are important for receptor binding are not well defined.

ORF 4 (bases 27051-27380) encodes a predicted protein with 109 amino acids. This ORF overlaps with the ORF that encodes the E protein. PFAM analysis of the ORF shows that the predicted protein is a member of the coronavirus non-structural protein NS2 family (PFAM accession no.: PF04753). TMpred and TMHMM analysis do not reveal any transmembrane helix. This predicted protein of CoV-HKU1 has 44-51% amino acid identities with the corresponding proteins of other Group 2 coronaviruses.

ORF 5 (bases 27373-27621) encodes the predicted E protein with 82 amino acids. The E protein of CoV-HKU1 has 54-60% amino acid identities with the E proteins of other Group 2 coronaviruses, but has fewer than 35% amino acid identities with the E proteins of Group 1, Group 3, and SARS-CoV (Table 4 and FIG. 5B). PFAM and InterProScan analyses of the ORF show that the predicted E protein is a member of the non-structural protein NS3/Small envelope protein E (NS3_envE) family (PFAM accession no.: PF02723). SignalP analysis predicts the presence of a transmembrane anchor (probability 0.995). TMpred analysis of the ORF shows two transmembrane domains at positions 16 to 34 and 39 to 59, and TMHMM analysis of the ORF shows two transmembrane domains at positions 10 to 32 and 39 to 58, consistent with the anticipated association of the E protein with the viral envelope. Both programs predict that both the N and C termini are located on the surface of the virus.

ORF 6 (bases 27633-28304) encodes the predicted M protein with 223 amino acids. The M protein of CoV-HKU1 has 76-78% amino acid identities with the M proteins of other Group 2 coronavirus, but has fewer than 40% amino acid identities with the M proteins of Group 1, Group 3, and SARS-CoV (Table 4 and FIG. 5B). PFAM analysis of the ORF shows that the predicted M protein is a member of the coronavirus matrix glycoprotein (Corona_M) family (PFAM accession no.: PF01635). SignalP analysis predicts the presence of a transmembrane anchor (probability 0.926). TMpred analysis of the ORF shows three transmembrane domains at positions 21 to 42, 53 to 74, and 77 to 98. TMHMM analysis of the ORF shows three transmembrane domains at positions 20 to 39, 46 to 68, and 78 to 100. The N terminal 19-20 amino acids are located on the outside and the C terminal 123-125-amino acid hydrophilic domain on the inside of the virus.

ORF 7 (bases 28320-29645) encodes the predicted N protein (PFAM accession no.: PF00937) with 441 amino acids. The N protein of CoV-HKU1 has 57-62% amino acid identities with the N proteins of other Group 2 coronaviruses, but has fewer than 40% amino acid identities with the N proteins of Group 1, Group 3, and SARS-CoV (Table 4 and FIG. 5B).

ORF 8 (bases 28342-28959) encodes a hypothetical protein (N2) of 205 amino acids within the ORF that encodes the predicted N protein. PFAM analysis of the ORF shows that the predicted protein is a member of the coronavirus nucleocapsid I protein (Corona_I) family (PFAM accession no.: PF03187). This hypothetical N2 protein of CoV-HKU1 has 32-39% amino acid identities with the N2 proteins of other Group 2 coronaviruses.

We report the characterization and complete genome sequence of a novel coronavirus detected in the nasopharyngeal aspirates of patients with pneumonia. The clinical significance of the virus in the first patient was evident by the high viral loads in the patient's nasopharyngeal aspirates during the first week of his illness, which coincided with the acute symptoms developed in the patient. The viral load decreased during the second week of the illness and was undetectable in the third week of the illness. In addition, the fall in viral load was accompanied by the recovery from the illness and development of specific antibody response to the recombinant N protein of the virus. Similar to other recently discovered viruses, such as hepatitis C virus, GB virus C, transfusion transmitted virus, and SEN virus, the present virus could not be recovered from cell cultures using the standard cell lines. This could be related to the inherently low recovery rate of coronaviruses. Human coronaviruses are particularly difficult to culture in vitro. Many decades after the recognition of HCoV-229E and HCoV-OC43, there are still only a handful of primary virus isolates available and organ culture is required for primary isolation of HCoV-OC43. In our experience, SARS-CoV can only be recovered from less than 20% of patients with serologically and RT-PCR documented SARS-CoV pneumonia. Therefore, it is not surprising that the new coronavirus CoV-HKU1 has been so far proven difficult to culture in vitro. After the discovery of CoV-HKU1 in the first patient, we conducted a preliminary study on 400 nasopharyngeal aspirates that were collected last year during the SARS epidemic period. Among these 400 nasopharyngeal aspirates, CoV-HKU1 was detected in one specimen, with a viral load comparable to that of the first patient. These results have suggested that CoV-HKU1 is not only incidentally found in one patient, but a previously unrecognized coronavirus associated with pneumonia.

Genomic analysis has reveals that CoV-HKU1 is a Group 2 coronavirus. The genome organization of CoV-HKU1 concurs with those of other coronaviruses, with the characteristic gene order, i.e., 5'-replicase, S, E, M, N-3', short untranslated regions in both 5' and 3' ends, 5' conserved coronavirus core leader sequence, putative TRS upstream to multiple ORFs, and conserved pseudoknot in the 3' untranslated region. In contrast to coronaviruses of other groups, CoV-HKU1 contains certain features that are characteristics of Group 2 coronaviruses, including the presence of HE, ORF 4, and N2. Phylogenetic analysis of the $3CL^{pro}$, replicase, helicase, S, E, M, and N proteins showed that these genes of CoV-HKU1 were clustered with the corresponding genes in other Group 2 coronaviruses. However, the proteins of CoV-HKU1 formed distinct branches in the phylogenetic trees, indicating that CoV-HKU1 is a distinct member of the group, and is not very closely related to any other known members of Group 2 coronaviruses (FIGS. 4A and 4B).

In addition to phylogenetic analysis of the putative proteins, CoV-HKU1 exhibits certain features that are distinct from other Group 2 coronaviruses. Compared to other Group 2 coronaviruses, there is a deletion of about 800 bps between the replicase ORF 1b and the HE ORF 2 in CoV-HKU1. In other Group 2 coronaviruses, including MHV, SDAV, HCoV-OC43 and BCoV, an ORF of 798-837 bp (273-278 amino acids) is present between the replicase 1b ORF and the HE ORF 2. This ORF encodes a protein of the coronavirus non-structural protein NS2a family (PFAM accession no.: PF05213). The absence of this ORF in CoV-HKU1 indicates that this is probably a non-essential gene of coronavirus. In addition to the deletion, the N-terminal of the putative PLP in ORF 1a contains 14 tandem copies of a 30-bp repeat that codes for a highly acidic domain. Similar repeats, with different amino acid compositions, have been found in the genomes of human, rat and parasites, but have not been found in other coronaviruses. The function of these repeats is not well understood, although some authors have suggested that the repeats could be important antigens, and their biological role may be related to their special three-dimensional structures. The vitellaria antigenic protein of *Clonorchis sinensis* contains 23 tandem copies of a 30-bp repeat that codes for DGGAQP-PKSG (SEQ ID NO:20). In the case of *Plasmodium falciparum*, it has been shown that the antigenicity of the circumsporozoite protein is due to its repeating epitope structure. It has also been suggested that the tandemly repeated peptide may induce strong humoral immune response in the infected host and thus may also be useful in serological diagnosis. Further experiments should be performed to delineate the antigenic properties, biological role, and possible clinical usefulness of the repeat in the PLP of CoV-HKU1.

The geographical, political, and economic location of Hong Kong makes it a unique place for the study of emerging infectious disease. Hong Kong, as the gateway of southern China, with thousands of people crossing the border on surface and by air every day, has a high potential of importing and exporting infectious diseases to and from China, countries in Southeast Asia and from the rest of the world. In 1997, the first 18 human cases of avian influenza A H5N1 virus infection were reported in Hong Kong. In early 2003, two cases of human infection caused by avian influenza A (H5N1) that was acquired in Fujian, were diagnosed in Hong Kong, which provided an early warning of the impending disease threat for humans and poultry in Southeast Asia that followed in 2004. For the SARS epidemic, although both epidemiological and genomic evidence revealed that the disease had first occurred in southern China in November 2002, it did not receive as much international attention until the disease was spread to Hong Kong and through Hong Kong to Singapore, Toronto, Vietnem, and the United States of America. As for emerging bacterial infections, 50% of the patients with gastroenteritis associated with the recovery of *Laribacter hongkongensis* had recent history of travel to southern China. In this report, one of the patients also had recent history of travel to Shenzhen of China prior to the development of the respiratory illness. We speculate that he might have contacted the virus in Shenzhen. More intensive surveillance of emerging infectious pathogens in this locality is warranted.

6.2 Example 2

We prospectively collected nasopharyngeal aspirates (NPAs) from patients with community-acquired pneumonia during a 12-month period. A 453-bp fragment of the pol gene of CoV-HKU1 was amplified from the extracted RNA by RT-PCR using CoV-HKU1 specific primers. The epidemiological, clinical, laboratory and radiological features of patients with pneumonia associated with CoV-HKU1 were analyzed. Specific antibodies were detected using a recombinant CoV-HKU1 N protein based ELISA. The complete pol, S and N genes of the CoV-HKU1 were amplified and sequenced. RNA extracted from 208 nasopharyngeal swabs and fecal samples from 56 wild and domestic animals in Hong Kong and southern China were subject to RT-PCR of pol gene of CoV-HKU1 using CoV-HKU1 specific primers.

6.2.1 Patients and Microbiological Methods

All prospectively collected NPAs from patients with community-acquired pneumonia sent to the clinical microbiology laboratories of four regional hospitals in Hong Kong during a 12-month period [Mar. 22, 2003 (beginning of SARS epidemic in Hong Kong)—Mar. 21, 2004] for detection of SARS-CoV but negative for SARS-CoV RNA by RT-PCR were included in the study. Community-acquired pneumonia is defined as symptoms and signs consistent with an acute lower respiratory tract infection associated with new radiographic shadowing for which there is no other explanation that develop prior to or within 48 h after presentation to hospital. Once CoV-HKU1 was detected from NPAs, the hospital records, laboratory results and chest radiographs of the corresponding patients were retrieved and examined by two infectious disease physicians. The RNA extracted from the NPAs was subject to RT-PCR for influenza A virus and human metapneumovirus (Peiris J S M et. al., *Lancet* 2003; 361: 1319-25). Available stored serum samples were subject to serological assays for detection of antibodies against *Mycoplasma, Chlamydia, Legionella* and SARS-CoV by SERODIA-MYCO II (Fujirebio Inc., Tokyo, Japan), *Chlamydia pneumoniae* MIF IgG (Focus technologies, Cypress, Calif., USA), indirect immunofluorescence (MRL, San Diego, Calif., USA) and our recently developed enzyme-linked immunosorbent assay (ELISA), respectively (Woo P C Y et al., *Lancet* 2004; 363:841-5).

To determine the possible risk factors associated with CoV-HKU1 pneumonia, two age- and sex-matched controls per patient with CoV-HKU1 pneumonia were randomly selected from those with community-acquired pneumonia but their NPAs negative for CoV-HKU1. Controls were within five years older or younger than the corresponding patients with CoV-HKU1 pneumonia, and were admitted within 15 days before or after admission of the corresponding patients with CoV-HKU1 pneumonia. The hospital records, laboratory results and chest radiographs of the controls were retrieved and examined by the two infectious disease physicians.

6.2.2 RNA Extraction

Viral RNA was extracted from NPAs using QIAamp Viral RNA Mini Kit (QIAgen, Hilden, Germany) according to the manufacturer's instructions within 10 h upon receipt of specimens. The eluted RNA was used as the template for RT-PCR. All extracted RNA was stored immediately at −70° C. until use.

6.2.3 RT-PCR of RNA-Dependent RNA Polymerase Gene of Coronavirus-HKU1 Using Coronavirus-HKU1 Specific Primers and DNA Sequencing A 453-bp fragment of the RNA dependent RNA polymerase (pol) gene of CoV-HKU1 was amplified by RT-PCR using CoV-HKU1 specific primers, 5'-AAAGGATGTTGACAACCCTGTT-3' (LPW1926; SEQ ID NO:2968) and 5'-ATCATCATACTAAAATGCTTACA-3' (LPW1927; SEQ ID NO:2969) designed by multiple alignment of the nucleotide sequences of the pol genes of the two CoV-HKU1 (Woo, P C. et al., *J. of Virol*., 2005, p. 884-895) and those of the available pol genes of other known human coronaviruses. RT was performed using the SuperScript II kit (Invitrogen, San Diego, Calif., USA) according to manufacturer's instructions. The PCR mixture (50 μl) contained cDNA, PCR buffer (10 mM Tris-HCl pH 8.3, 50 mM KCl, 3 mM $MgCl_2$ and 0.01% gelatin), 200 μM of each dNTPs and 1.0 U Taq polymerase (Boehringer Mannheim, Germany). The mixtures were amplified in 40 cycles of 94° C. for 1 min, 48° C. for 1 min and 72° C. for 1 min, and a final extension at 72° C. for 10 min in an automated thermal cycler (Perkin-Elmer Cetus, Gouda, The Netherlands). Distilled water was used as the negative control. To ensure the high specificity of the CoV-HKU1 specific primers, RNA extracted from 200 NPAs positive for influenza A and B viruses, parainfluenza viruses 1-3, respiratory syncytial virus (RSV), or adenovirus antigens and RNA of HCoV-229E, HCoV-OC43, HCoV-NL63 and SARS-CoV were also subject to RT-PCR using the two CoV-HKU1 specific primers.

Ten microlitres of each amplified product was electrophoresed in 1.5% (w/v) agarose gel, with a molecular size marker (ΦX-174 DNA HaeIII digest, Boehringer Mannheim, Germany) in parallel. Electrophoresis in Tris-borate-EDTA buffer was performed at 100 V for 1.5 h. The gel was stained with ethidium bromide (0.5 μg/ml) for 15 minutes, rinsed and photographed under ultraviolet light illumination.

The PCR products were gel-purified using the QIAquick gel extraction kit (QIAgen, Hilden, Germany). Both strands of the PCR products were sequenced twice with an ABI Prism 3700 DNA Analyzer according to manufacturers' instructions (Applied Biosystems, Foster City, Calif., USA), using the two PCR primers. The sequences of the PCR products were compared with the sequences of the pol genes of the two CoV-HKU1 (Woo, P C. et al., *J. of Virol*., 2005, p. 884-895) and those of the pol genes of coronaviruses in the GenBank database.

6.2.4 ELISA Using Recombinant Nucleocapsid Protein of CoV-HKU1

The ELISA-based IgG and IgM antibody tests were performed according to our published protocol (Woo, P C. et al., *J. of Virol*., 2005, p. 884-895). Briefly, each well of a Nunc immunoplate (Roskilde, Denmark) was coated with purified $(His)_6$-tagged recombinant N protein (20 ng for IgG and 80 ng for IgM) for 1 h and then blocked in phosphate-buffered saline with 5% skim milk. The serum samples obtained from the patients during the acute and convalescent phase of the illness were serially diluted and were added to the wells of the $(His)_6$-tagged (SEQ ID NO: 27) recombinant N protein-coated plates in a total volume of 100 μl and incubated at 37° C. for 2 h. After washing with washing buffer five times, 100 μl of diluted horse radish peroxidase-conjugated goat anti-human IgG (1:4000) and mouse anti-human IgM (1:1000) antibodies (Zymed Laboratories Inc., South San Francisco, Calif., USA) were added to the wells and incubated at 37° C. for 1 h. After washing with washing buffer five times, 100 μl diluted 3,3',5,5'-tetramethylbenzidine (Zymed Laboratories Inc.) were added to each well and incubated at room temperature for 15 min. One hundred microlitres of 0.3 M $H_2SO_4$ were added and the absorbance at 450 nm of each well was measured. Each sample was tested in duplicate and the mean absorbance for each serum was calculated.

6.2.5 RT-PCR and Sequencing of the Complete RNA-Dependent RNA Polymerase, Spike and Nuclocapsid Genes of Coronavirus-HKU1 and Phylogenetic Analysis The complete pol, spike (S) and N genes of CoV-HKU1 from NPAs of nine of the 10 patients, with adequate amount of RNA available, were amplified and sequenced using the RNA extracted from the NPAs as template. The RNA was converted to cDNA by a combined random-priming and oligo(dT) priming strategy. The cDNA was amplified by degenerate primers designed by multiple alignment of the regions encoding the pol, S and N genes in the genomes of the two CoV-HKU1 (Woo, P C. et al., *J. of Virol*., 2005, p. 884-895) and those of other group 2 coronaviruses and additional primers designed from the results of the first and subsequent rounds of sequencing. Sequences were assembled and manually edited to produce the complete sequences of the pol, S and N genes of CoV-HKU1 from different patients. The nucleotide and the deduced amino acid sequences of the pol, S and N genes were compared to those of the two CoV-HKU1 (Woo, P C. et al., *J. of Virol*., 2005, p. 884-895) and other group 2 coronaviruses. Phylogenetic tree construction was performed using PileUp method with GrowTree (Genetics Computer Group, Inc.).

6.2.6 Animal Surveillance

Two hundred and eight nasopharyngeal swabs and faecal samples from 56 wild and domestic animals [including Chinese ferret-badger (*Melogale moschata*), domestic cat (*Felis catus*), hog-badger (*Arctonyx collaris*), masked palm civet (*Paguma larvata*), racoon dog (*Nyctereutes procyonoides*), Chinese pygmy dormouse (*Typhlomys cinereus*), common pangolin (*Manis pentadactyla*), nutria (*Myocastor coypus*), dog (*Canis familiaris*), rabbit (Leporidae family), snake (Serpentes suborder) and bat (Microchiroptera suborder)] in Hong Kong and southern China (Guan Y, et al., *Science* 2003; 302: 276-8) were subjected to RNA extraction and RT-PCR of pol gene of CoV-HKU1 using the CoV-HKU1 specific primers (LPW1926; SEQ ID NO:2968 and LPW1927; SEQ ID NO:2969) and protocol described above.

6.2.7 Results

Clinical and Laboratory Characteristics

During the 12-month period, NPAs from 418 patients [male:female=198:220, age (mean±SD)=49±26] with community-acquired pneumonia, for detection of SARS-CoV but were negative for SARS-CoV RNA by RT-PCR, were identified in the four hospitals. A 453-bp fragment of the pol gene of CoV-HKU1 was amplified and sequenced in 10 (2.5%) patients. Sequence analysis revealed 0-2% nucleotide differences between the sequences of the fragments and the sequence of the pol gene of the CoV-HKU1 from the reported index patient (patient no. 5) described in Example 1 above (FIG. 11) (Woo, P C. et al., *J. of Virol*., 2005, p. 884-895). In contrast, using our CoV-HKU1 specific primers, none of the 200 NPAs that were positive for influenza A and B viruses, parainfluenza viruses 1-3, RSV, or adenovirus antigens and RNA of HCoV-229E, HCoV-OC43, HCoV-NL63 and SARS-CoV, was RT-PCR positive.

The epidemiological, clinical and radiological characteristics of the 10 patients, including patient no. 5 (Woo, P C. et al., *J. of Virol*., 2005, p. 884-895), with community-acquired pneumonia associated with CoV-HKU1 are summarized in Table 5. No epidemiological linkage was identified among the 10 cases. All cases occurred in either winter or spring (January-May). The median age was 71.5 (range: 13-96). Seven were males and three were females. Nine were Chinese and one was an Arabian. Eight had underlying diseases, and four had underlying diseases of the respiratory tract. Four had recent travel histories to southern China. Five were smokers. Clinically, the illness was not distinguishable from other community-acquired pneumonia. Fever, productive cough and dyspnoea were common presenting symptoms. Upper respiratory tract symptoms were present in only two patients (patient nos. 1 and 5). One patient (patient no. 7) had loose stool diarrhea. Oxygen saturation on room air upon admission was <95% in two. Airspace shadows were observed in the right lungs of six patients and the left lungs of six patients. The upper, middle and lower zones were affected in two, four and nine patients respectively. All patients, except patient no. 10, had normal platelet counts and normal liver and renal function tests. Bacterial or mycobacterial pathogens were not detected in any of the sputum samples from the patients. Direct antigen detection for influenza A and B viruses, parainfluenza viruses 1-3, RSV, adenovirus (Woo P C Y et al., *J Clin Microbiol* 1997; 35: 1579-81) and RT-PCR for influenza A virus and metapneumovirus, was negative in all NPAs. Antibodies against *M. pneumoniae, C. pneumoniae, C. psittaci, L. pneumophila* and SARS-CoV were negative in all the six patients (patient nos. 1, 4, 5, 6, 8 and 9) whose serum samples were available. All these six patients showed a four-fold change in IgG titer (patient nos. 4, 5 and 6) and/or the presence of IgM (patient nos. 1, 5, 8 and 9) against CoV-HKU1.

TABLE 5

| | Patient no. | | | | |
|---|---|---|---|---|---|
| Characteristics | 1 | 2 | 3 | 4 | 5 |
| Month/Year | Mar/03 | Apr/03 | May/03 | Jan/04 | Jan/04 |
| Sex/Age | F/35 | M/66 | M/13 | M/75 | M/71 |
| Ethnic origin | Chinese | Arabian | Chinese | Chinese | Chinese |
| Underlying diseases | – | Diabetes mellitus, old myocardial infarction, gastric lymphoma | Asthma, situs inversus, dextrocardia | Hypertension | Chronic obstructive airway disease, hyperlipidaemia, abdominal aortic aneurysm |
| History of travel within two weeks of disease onset | – | – | Shenzhen, China | Guangdong, China | Shenzhen, China |
| History of smoking | – | – | – | + | + |
| Clinical features | | | | | |
| Fever | + | – | + | – | + |
| Chills | – | – | – | – | + |
| Rigor | – | – | – | – | – |
| Myalgia | – | – | – | – | – |
| Headache | – | – | – | – | + |
| Cough | + | – | + | + | + |
| Sputum | – | – | + | + | + |

TABLE 5-continued

| | | | | | |
|---|---|---|---|---|---|
| production | | | | | |
| Dyspnoea | – | + | – | + | – |
| Pleurisy | – | – | – | – | – |
| Rhinorrhoea | – | – | – | – | + |
| Sore throat | + | – | – | – | + |
| Oxygen saturation on room air (%) | 99 | 83 | 100 | 99 | 99 |
| Chest radiograph features | RLZ airspace shadows | Bilateral airspace shadows | LMZ and LLZ airspace shadows | LLZ airspace shadows | LLZ airspace shadows |
| Outcome | Survived | Died | Survived | Survived | Survived |
| Duration of hospitalization (no. of days) | 2 | Died on day 12 | 3 | 7 | 5 |

| | Patient no. | | | | |
|---|---|---|---|---|---|
| Characteristics | 6 | 7 | 8 | 9 | 10 |
| Month/Year | Jan/04 | Jan/04 | Jan/04 | Mar/04 | Mar/04 |
| Sex/Age | F/96 | M/78 | M/68 | F/83 | M/72 |
| Ethnic origin | Chinese | Chinese | Chinese | Chinese | Chinese |
| Underlying diseases | Hypertension | Chronic obstructive airway disease, diabetes mellitus | – | Chronic obstructive airway disease, parathyroid adenoma, dementia | Prostate carcinoma, cerebrovascular accident, diabetes mellitus |
| History of travel within two weeks of disease onset | – | – | Guangdong, China | – | – |
| History of smoking | – | + | – | + | + |
| Clinical features | | | | | |
| Fever | + | + | + | + | + |
| Chills | – | – | – | – | – |
| Rigor | – | – | – | – | – |
| Myalgia | – | – | – | – | – |
| Headache | – | – | – | – | – |
| Cough | – | + | + | – | + |
| Sputum production | – | + | + | – | + |
| Dyspnoea | – | + | + | + | + |
| Pleurisy | – | – | – | – | – |
| Rhinorrhoea | – | – | – | – | |
| Sore throat | – | – | – | – | – |
| Oxygen saturation on room air (%) | 97 | 97 | 95 | 99 | 88 |
| Chest radiograph features | RLZ airspace shadows | LLZ airspace shadows | RMZ airspace shadows | RLZ airspace shadows | Bilateral airspace shadows |
| Outcome | Survived | Survived | Survived | Survived | Died |
| Duration of hospitalization (no. of days) | 7 | 13 | 5 | 6 | Died on day 6 |

+ = present;
– = absent;
RUZ = right upper zone;
LUZ = left upper zone;
RMZ = right middle zone;
LMZ = left middle zone;
RLZ = right lower zone;
LLZ = left lower zone In comparison with age- and sex-matched controls with non-CoV-HKU1 pneumonia, no epidemiological, clinical, haematological, serum biochemical and radiological risk factors were identified in patients with CoV-HKU1 pneumonia (Table 6).

TABLE 6

| | Pneumonia* | | |
|---|---|---|---|
| | CoV-HKU1 (n = 10) | Non-CoV-HKU1 (n = 20) | P value |
| Characteristics | | | |
| Underlying diseases | 8 | 12 | 0.42 |
| History of travel within two weeks of disease onset | 4 | 6 | 0.69 |
| History of smoking | 5 | 7 | 0.46 |
| Clinical features | | | |
| Fever | 8 | 14 | 0.68 |
| Cough | 7 | 17 | 0.37 |
| Sputum production | 6 | 12 | 1.00 |
| Dyspnoea | 6 | 6 | 0.12 |
| Rhinorrhoea | 1 | 2 | 1.00 |
| Sore throat | 2 | 2 | 0.58 |
| Haematological features | | | |
| Haemoglobin (g/dl) | 12.4 | 13.2 | 0.27 |
| Leukocyte count ($\times 10^9$/l) | 9.9 | 9.7 | 0.95 |
| Neutrophil count ($\times 10^9$/l) | 7.35 | 7.4 | 0.71 |
| Lymphocyte count ($\times 10^9$/l) | 0.95 | 1.02 | 0.48 |
| Monocyte count ($\times 10^9$/l) | 0.55 | 0.65 | 0.35 |
| Platelet count ($\times 10^9$/l) | 240 | 292 | 0.20 |
| Serum biochemical features | | | |
| Sodium (mmol/l) | 136 | 137 | 0.59 |
| Potassium (mmol/l) | 3.9 | 4.0 | 0.42 |
| Creatinine (μmol/l) | 92 | 76.5 | 0.06 |
| Urea (mmol/l) | 5.25 | 4.9 | 0.62 |
| Albumin (g/l) | 37 | 38 | 0.59 |
| Globulin (g/l) | 36.5 | 30 | 0.07 |
| Bilirubin (μmol/l) | 12 | 10 | 1.00 |
| ALT (U/l) | 20 | 17 | 0.42 |
| Alkaline phosphatase (U/l) | 102 | 91 | 0.95 |
| Oxygen saturation on room air (%) | 96 | 98 | 0.86 |
| Radiological features | | | |
| Bilateral involvement | 2 | 5 | 1.00 |
| No. of zones involved | 1 | 1 | 0.81 |
| Mortality | 2 | 0 | 0.10 |

*Continuous variables are expressed as median and categorical variables as no. of patients with the presence of the characteristics.

Two of the 10 patients died of CoV-HKU1 pneumonia. The first patient (patient no. 2) was a 66-year old man who presented with dyspnoea for one day. He had type 2 diabetes mellitus, old myocardial infarction and gastric lymphoma with total gastrectomy in 2002 and was put on chemotherapy. He had severe lymphopenia ($0.2\times10^9$/L) and an oxygen saturation of only 83% on admission. Chest radiograph revealed patchy airspace shadows in both lungs with predominant involvement of the lower zones (FIG. 12A). He died 11 days after admission. The other patient (patient no. 10) was a 72-year old man who presented with fever and productive cough for one week. He had type 2 diabetes mellitus, cerebrovascular accident and prostatic carcinoma with bone metastasis complicated by spinal cord compression with laminectomy and Luque instrumentation performed. He had lymphopenia ($0.9\times10^9$/L), thrombocytopenia ($33\times10^9$/L), deranged liver and renal function tests and an oxygen saturation of only 88% on admission. Chest radiograph revealed extensive airspace shadows in both lungs, with the middle zones more severely involved (FIG. 12B). He died 5 days after admission.

The clinical, laboratory and radiological characteristics of patients who survived and those who died with community acquired pneumonia associated with CoV-HKU1 were compared (Table 7). Patients who died had lower hemoglobin concentration (P=0.04), monocyte count (P=0.04), serum albumin (P=0.04) and oxygen saturation on admission (P=0.03) and bilateral involvement (P=0.003) and more number of zones involved (P=0.01) on chest radiograph.

TABLE 7

| | Outcome* | | |
|---|---|---|---|
| | Survived (n = 8) | Died (n = 2) | P value |
| Characteristics | | | |
| Sex (M:F) | 5:3 | 2:0 | 1.00 |
| Age | 73 | 69 | 0.60 |
| Underlying diseases | 6 | 2 | 0.45 |
| History of travel within two weeks of disease onset | 4 | 0 | 0.24 |
| History of smoking | 4 | 1 | 1.00 |
| Clinical features | | | |
| Fever | 7 | 1 | 0.26 |
| Cough | 6 | 1 | 0.51 |
| Sputum production | 5 | 1 | 0.76 |
| Dyspnoea | 4 | 2 | 0.22 |
| Rhinorrhoea | 1 | 0 | 0.62 |
| Sore throat | 2 | 0 | 0.45 |
| Haematological features | | | |
| Haemoglobin (g/dl) | 13.4 | 9 | 0.04 |
| Leukocyte count ($\times 10^9$/l) | 9.7 | 7.85 | 0.43 |
| Neutrophil count ($\times 10^9$/l) | 7.4 | 6.9 | 0.79 |
| Lymphocyte count ($\times 10^9$/l) | 1.35 | 0.55 | 0.15 |
| Monocyte count ($\times 10^9$/l) | 0.7 | 0.3 | 0.04 |
| Platelet count ($\times 10^9$/l) | 292 | 200.5 | 0.79 |
| Serum biochemical features | | | |
| Sodium (mmol/l) | 137.5 | 134 | 0.11 |
| Potassium (mmol/l) | 3.9 | 4.5 | 0.06 |
| Creatinine (μmol/l) | 79 | 76.5 | 0.69 |
| Urea (mmol/l) | 4.6 | 10.75 | 0.19 |
| Albumin (g/l) | 38.5 | 26 | 0.04 |
| Globulin (g/l) | 30 | 30 | 1.00 |
| Bilirubin (μmol/l) | 10 | 30.5 | 0.79 |
| ALT (U/l) | 16.5 | 30.5 | 0.36 |
| Alkaline phosphatase (U/l) | 86 | 190.5 | 0.07 |
| Oxygen saturation on room air (%) | 99 | 85.5 | 0.03 |
| Radiological features | | | |
| Bilateral involvement | 0 | 2 | 0.003 |
| No. of zones involved | 1 | 6 | 0.01 |

*Continuous variables are expressed as median and categorical variables as no. of patients with the presence of the characteristics.

RT-PCR and Sequencing of the Complete RNA-Dependent RNA Polymerase, Spike and Nucleocapsid Genes of Coronavirus-HKU1 and Phylogenetic Analysis The complete pol (FIG. 11), S (FIG. 13) and N (FIG. 14) genes of CoV-HKU1 from NPAs of nine of the 10 patients, with adequate amount of RNA available, were amplified and sequenced. The phylogenetic trees and non-synonymous mutations and the corresponding amino acid changes are shown in FIG. 15. In all three genes, the phylogenetic trees using nucleotides or amino acids for construction showed the same topologies. For the S gene, there were 317 and 306 nucleotide positions with synonymous and non-synonymous mutations respectively (FIG. 15B). For the N gene, there were 42 and 53 nucleotide positions with synonymous and non-synonymous mutations respectively (FIG. 15C). The nucleotide sequences of seven of the nine S or N genes showed similar sequences (genotype A, FIGS. 15B and 15C) and those of the other two also showed similar sequences (genotype B, FIGS. 15B and 15C). For the CoV-HKU1 from patient 1, two peaks (T and C) were consistently observed at nucleotide position 1300 of the N gene, suggesting the presence of quasi-species (FIG. 15C). For the pol gene, there were 95 and 13 nucleotide positions with synonymous and non-synonymous mutations respectively (FIG. 15A). The nucleotide sequences of the pol genes in the seven CoV-HKU1 of genotype A were also clustered together (FIG. 15A). Interestingly, the seven CoV-HKU1 of genotype A were from seven patients with underlying diseases and the two of genotype B were from the two patients without underlying diseases (Table 5). Furthermore, multiple alignments of the nucleotides sequences of the pol genes of the nine CoV-HKU1 and those of HCoV-OC43, HCoV-229E, HCoV-NL63 and SARS-CoV revealed that the primers we used in the present study should be specific for CoV-HKU1 (FIG. 16).

Animal Surveillance

None of the 208 nasopharyngeal swabs and faecal samples from 56 wild and domestic animals in Hong Kong and southern China was positive for CoV-HKU1 RNA.

6.2.8 Discussion

CoV-HKU1, a novel group 2 coronavirus, is associated with community-acquired pneumonia. Since the SARS epidemic in 2003, we have started to prospectively collect NPAs and store the extracted RNA from patients with community-acquired pneumonia so that when a novel virus is discovered, the epidemiology and hence the clinical, laboratory and radiological features of the disease can be studied timely. In January 2004, we discovered a novel coronavirus, CoV-HKU1, from a patient with community-acquired pneumonia (Woo, P C. et al., *J. of Virol*., 2005, p. 884-895). The RNA extracted from prospectively collected NPAs were immediately retrieved and the presence of CoV-HKU1 RNA looked for. Ten of the 418 NPAs were positive for RNA of CoV-HKU1, giving an incidence of 2.5%. The presence of CoV-HKU1 RNA in these specimens was genuine, instead of due to contamination, as amplification and sequencing of multiple genes (pol, S and N) of CoV-HKU1 indicated the presence of CoV-HKU1 with different nucleotide sequences in the NPAs from the different patients. Moreover, the clinical significance of CoV-HKU1 was further confirmed by the presence of specific antibody responses in all six patients whose serum samples were available.

Similar to HCoV-229E, HCoV-OC43 and HCoV-NL63, CoV-HKU1 is probably a human coronavirus that is endemic in human. Similar to other human coronavirus infections, cases of CoV-HKU1 pneumonia also occurred in winter and spring. Most patients with CoV-HKU1 pneumonia were old (80% older than 65) with major underlying diseases, especially those of the respiratory and cardiovascular systems. In order to study the phylogeny and relationships among the 10 CoV-HKU1, we sequenced the pol, S and N genes of the nine CoV-HKU1 cases which provided adequate amount of RNA. Combined with the data of partial sequencing of the pol genes of the 10 CoV-HKU1 (FIG. 17), results showed that unlike the epidemiology of SARS-CoV, the 10 CoV-HKU1 were not clonal and the topology of the phylogenetic trees did not follow the pattern of a clonal outbreak (FIG. 15). Interestingly, the phylogenetic tress constructed using the sequences of both the S and N genes showed that CoV-HKU1 of genotype B was associated with the two patients without underlying diseases, but CoV-HKU1 of genotype A was associated with patients with underlying diseases (Table 5; and FIGS. 16B and 16C). Sequencing of more CoV-HKU1 may reveal the presence of genotypes or clades of CoV-HKU1 with differential virulence. To investigate for the possibility of an animal reservoir of CoV-HKU1, we tried to look for the presence of CoV-HKU1 RNA from wild and domestic animals in Hong Kong and southern China by RT-PCR. Our results revealed that none of the specimens showed the presence of CoV-HKU1 RNA. With the results of these clinical epidemiology, molecular epidemiology and eco-epidemiology studies, we conclude that CoV-HKU1 is probably a human coronavirus.

Compared with SARS-CoV pneumonia, CoV-HKU1 pneumonia is a monophasic disease and most patients had relatively mild symptoms that were localized to the respiratory tract and were only briefly hospitalized. SARS-CoV pneumonia is often described as a biphasic disease, with the first phase due to cell lysis as a result of active viral replication, and the second phase may be due to immunopathological damage (Peiris J S M et al., *Lancet* 2003; 361: 1319-25; Peiris J S M et al., *Lancet* 2003; 361: 1767-72). On the other hand, all 10 patients with CoV-HKU1 pneumonia showed the pattern of a monophasic disease. Although dyspnoea was present in half of the patients with CoV-HKU1 pneumonia at initial presentation, as compared to only about 20% of patients with SARS-CoV pneumonia at initial presentation (Peiris J S M et al., *Lancet* 2003; 361: 1319-25), patients with CoV-HKU1 pneumonia often recovered quickly, but patients with SARS-CoV pneumonia deteriorated after 7-10 days (Peiris J S M et al., *Lancet* 2003; 361:1319-25; Peiris J S M et al., *Lancet* 2003; 361: 1767-72). For the eight patients who recovered, the median duration of hospitalization was only 5.5 days. This rapid recovery of patients with CoV-HKU1 pneumonia could be related to the rapid control of the virus by the immune system. This is in line with our previous study showing the index patient (patient 5) with CoV-HKU1 pneumonia had his peak viral load at around day 3 after onset of illness (Woo, P C. et al., *J. of Virol*., 2005, p. 884-895). Moreover, only one of the patients had extrapulmonary symptoms and all available extrapulmonary specimens (stool, urine and serum) were RT-PCR negative for CoV-HKU1 (unpublished data). On the other hand, for SARS-CoV pneumonia, patients usually had their peak viral loads 7-10 days after the onset of illness (Peiris J S M et al., *Lancet* 2003; 361: 1767-72). Furthermore, the virus can be readily detected in extrapulmonary specimens, in which the viral loads correlated with the manifestations in the corresponding systems (Hung, I F N et al., *Emerg Infect Dis* 2004; 10: 1550-1557). These imply that the virus was not well controlled by the immune system in the initial phase of the illness.

Despite the relatively mild disease in most patients, CoV-HKU1 pneumonia is associated with mortality in a minority of patients who had lower haemoglobin concentration, monocyte count, serum albumin and oxygen saturation on admission and more extensive involvement on chest radiograph. As in most cases of pneumonia, more extensive involvement in the lungs will result in poor gaseous exchange and hence hypoxia and eventually fatality. The lower haemoglobin concentration, monocyte count and serum albumin could represent poorer premorbid states and narrower margins to fight against infections. Both patients who died had underlying diabetes mellitus, malignancy (gastric lymphoma in one and carcinoma of the prostate in the other) and cardiovascular disease (old myocardial infarct in one and cerebrovascular accident in the other).

7. MARKET POTENTIAL

The two genomic types of CoV-HKU1 are completely sequenced. These sequences allow the development of various diagnostic tests and therapeutic methods as described hereinabove. In addition, the genetic information of CoV-HKU1 is extremely important and valuable for clinical and scientific research applications.

8. EQUIVALENTS

Those skilled in the art will recognize, or be able to ascertain many equivalents to the specific embodiments of the invention described herein using no more than routine experimentation. Such equivalents are intended to be encompassed by the following claims.

All publications, patents and patent applications mentioned in this specification are herein incorporated by reference into the specification.

Citation or discussion of a reference herein shall not be construed as an admission that such is prior art to the present invention.

SEQUENCE LISTING (4257 sequences)

SEQ ID NO: 1 - DNA, 393 bp, Corononavirus-HKU1
  CDS (2)..(391)
tcgtgctatgccaaatattttgcgtattgttagtagtttagttttggcccgcaaacatgaattttgttgttcacatggtgatagattttatcgccttgcgaatgaatgtgctcaagttttgagtgaaatagttatgtgtggcggttgctattatgttaagcctggtggtactagcagtggtgatgcaactactgcttttgctaattctgtttttaatatatgtcaggctgttactgctaatgtttgttctcttatggcctgtaatggccataagattgaagatttaagtatacgcaatttacaaaaacgcttatactctaatgtttatcgtacagattatgttgattatacatttgttaatgagtattatgaatttttatgtaagcattttag

SEQ ID NO: 2 - protein, 130 aa, Corononavirus-HKU1
RAMPNILRIVSSLVLARKHEFCCSHGDRFYRLANECAQVLSEIVMCGGCYYVKPGGTSSGDATTAFANSVFNICQAVTANVCSLMACNGHKIEDLSIRNLQKRLYSNVYRTDYVDYTFVNEYYEFLCKHF

SEQ ID NO: 3 - DNA, 29942 bp, Corononavirus-HKU1
gaataagagcgaattgcgtccgtaccgtctatcagcttacgatctcttgtcagatctcattaaatctaaactttttaaacaagattccctgttatccatgcttgtgagtgtggtttaatcataatcttgtattttactttccacacttttcatctctctgccagtgacgtgttggttgtcctcagcgtccctcccataggtcgcaatgattaaaaccagcaaatacggtctcggcttcaagtgggcgccagaatttcgttggctgcttccggatgcagcggaggagttggctagtcctatgaagtcagatgagggtgggttatgcccctctactggtcaagcgatggaaagtgttggattcgtttatgataatcatgtgaagatagattgtcgctgcattcttggacaagaatggcatgtgcagtcaaatcttatccgtgatatttttgttcatgaagatctacatgttgtagaagttctaactaaaacagccgtaaagtccggtacggcaattttaattaaatcacctttgcatagcttgggtggttttcctaaagggtatgttatgggcttgttccgttcatacaagactaaacgttatgttgtacatcatctttctatgactacatctactactaattttggtgaagattttttgggttggattgtaccttttggttttatgccatcttatgttcacaaatggtttcaattctgtaggttgtatattgaagagagtgatttaataatttcaaattttaaatttgatgattatgattttagtgtagaagatgcttatgctgaggttcatgctgagcctaaaggtaaatattcacaaaaagcttatgctttacttagacaatatcgtggtattaaacccgtactttttgtagaccagtatggttgtgactattctggtaaattagcagattgtcttcaagcttatggtcattattctttgcaagatatgagacaaaagcagtctgtatggcttgccaattgtgactttgatattgtagtggcttggcatgtagttcgtgattcacgatttgttatgcgcctgcagactatagctactatttgtggtattaaatatgttgcacaacctacagaagatgtagtagatggagatgtagttatacgtgaacctgtacatttattatctgctgatgcaatagttttaaagcttcctagtttgatgaaagttatgactcatatggatgatttttctattaaatctatatataatgttgatttgtgtgattgtggttttgttatgcagtatggttatgtagattgttttaatgataattgtgatttttatggttgggtttcaggtaatatgatggatggtttttcttgtccattgtgttgtacagtttatgactctagcgaagttaaagcccaatcatctggtgttattcctgaaaatcctgtgttatttactaatagtactgatactgttaaccatgattcttttaatttgtatggttattctgtcacaccatttggttcttgtatatattggtcgccgcgtcctggattgtggattcctataattaaatcttcagtcaagtcttatgatgatttggtttattcaggtgtagtaggttgtaaatctattgttaaagaaactgctcttattactcatgcactttacttagattatgttcaatgtaagtgtggtaatcttgaacaaaatcatattcttggcgttaataattcttggtgtaggcaactgttgcttaatagaggtgattataatatgcttctaaaaaatattgacttgtttgttaagcgtcgtgctgattttgcttgcaagtttgcagtttgtggagatggttttgtaccttttttactagatggtttaattccccgtagttattatctaattcagagtggtattttctttacatctttgatgtctcaattttcacaagaagtttctgatatgtgtttaaaaatgtgtattttgtttatggacagagtttcagttgctacattttatatagagcattatgttaataggttggttactcaatttaagttattgggtactacacttgttaataaaatggttaattggtttaataccatgttagatgctagtgcacctgctacaggctggcttctttaccaattattgaatggtctttttgtagtatctcaagccaactttaattttgttgctttaatacctgattatgctaaaattttagttaataaattttacactttttttaagttattattagagtgtgttacagttgatgttttaaaagatatgcctgttcttaaaactattaatggtttagtttgtattgtaggcaataagttttataacgttagtacagggttaattcctggttttgttttaccatgtaatgcacaggaacaacaaatttatttttttgaaggcgttgcagaatctgttatagtagaagatgatgttattgagaatgtcaaatcttctttatcatcttatgagtattgtcaaccacctaaatctgtagaaaaaatttgtattatagataatatgtacatgggtaagtgtggtgataaatttttccctattgtcatgaatgataaaaatatttgtcttttagatcaggcttggcgttttccatgtgcaggtagaaaagttaattttaacgagaaacctgttgttatggagattccgtctttgatgacagttaaggttatgtttgatttagattctacttttgatgatattttaggtaaagtttgttcagaatttgaagtagaaaagggtgttactgtagatgattttgttgctgttgtttgtgatgctatagagaatgctttaaactcttgtaaagagcatccagtggttggttatcaagttcgtgcatttttaaataaacttaatgagaatgttgtttatttatttgatgaggctggtgatgaagcaatggcctctcgtatgtattgtacttttgctattgaggatgttgaagacgttatcagtagtgaagctgtcgaagatactattgatggtgtcgttgaagacactattaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaataacgatgaagagattgttactggtgacaatgatgaccaaattgttgttactggtgatgatgtagatgatattgaaagtatttatgactttgatacttataaagctcttttagtttttaatgatgtctataatgatgctttgtttgttagttatggttctagtgttgaaacagaaacatattttaaagttaatggtttatggtcacctactattacacatactaattgttggttgcgttctgtgttacttgtaatgcagaaattaccttttaagtttaaggatttagctattgaaaatatgtggttatcttataaggtgggttataatcaaagttttgttgattatttactgaccactattcctaaagctattgttttgcctcaaggtggttttgtagctgattttgcttattggtttttaaaccagtttgatattaatgcgtatgctaattggtgttgtttaaaatgtggtttttcttttgatttaaatggtttggatgctttgtttttttatggagatattgtgtctcatgtttgtaagtgtggacataatatgactctaatagcagcggacttaccttgtacattacatttttcattatttgatgacaatttttgtgctttttgcacccctaaaaaaatttttattgctgcatgtgctgtggatgtaaacgtttgtcattctgtagctgttataggtgatgaacaaatagatggtaagtttgttactaaatttagtggtgataaatttgattttatagtaggttatggaatgtcatttagtatgtcttcttttgagttacctcaattgtatggtttgtgtataacacctaatgtatgttttgttaaaggtgatattataaatgttgctagacttgttaaagctgatgttattgttaatcctgctaatgggcatatgctccatggtggtggagttgcaaaagctatagctgtagctgcaggtaaaaaattttctaaagaaactgctgctatggttaaatctaaaggtgtttgccaagtaggagattgttatgtttctaccggtggtaaattatgtaaaacaattcttaatattgtaggccctgatgctagacaagatggaagacaatcttatgttttgttagcacgtgcttataagcatcttaataattatgattgttgtttgtctactctcatatcggctggtatatttagtgttcctgctgatgtgtcattaacttaccttctaggtgttgttgataaacaagttatccttgttagtaataataaagaagattttgatattattcaaaaatgtcaaattacttcagttgttggtactaaagcattggctgttagattaactgctaatgtaggccgtgttattaaatttgagacagatgcatacaaactttttttgagtggtgatgattgttttgtttcaaattcttctgttatacaagaagttttattgcttcgtcatgatatacaattgaataatgacgttcgtgattatttgttgtctaagatgactagtcttcctaaagattggcgtcttatcaataaatttgatgttattaacggtgttaaaactgttaagtattttgagtgtcctaattctatttatatatgtagtcagggtaaagactttggttatgtatgtgatggttctttttataaagcaactgttaatcaagtttgtgttttattagctaagaagatagatgttttgcttactgtagatggtgttaattttaaatctatttctcttactgtaggtgaagtttttggtaaaatacttggtaatgttttctgtgatggcattgatgttactaagttaaagtgtagtgatttttatgccgataaaattttatatcagtatgaaaatttgtctttagctgatatttctgctgtacaaagttcatttgggtttgatcagcaacaattgcttgcttattataattttttaacagtatgtaaatggtctgtagttgttaacggtccatttttttcttttgaacagtctcataataattgttatgtgaatgtagcttgtcttatgttgcagcatattaatcttaaatttaataaatggcagtggcaggaagcatggtatgaatttcgtgctggcagaccacataggttagttgctcttgttttagctaaaggtcattttaaatttgatgaaccatcagatgctactgattttattcgtgttgttttgaaacaagctgatttatcaggtgcaatttgtgaattagaacttatttgtgattgtggtattaaacaagaaagtcgtgttggtgttgatgctgttatgcattttggtacattagcaaagactgatctttttaatggttataagattggctgtaattgtgcaggtagaattgtccattgtactaaattgaatgtaccatttttgatttgttctaatactcctctgagtaaggatttacctgatgatgttgttgcagctaacatgtttatgggtgtaggtgtaggccattatacacatttgaaatgtggttcaccttaccaacattatgatgcttgtagtgttaaaaaatatacaggtgttagtggttgtttaactgactgcttgtatcttaaaaatttaacccagacttttacatctatgttgactaattattttttggatgatgttgaaatggttgcttataaccctgatctttcacaatattattgtgataatggtaagtattatacaaaacctattataaaggctcagtttaaaccatttgctaaagttgacggtgtttatactaactttaagttagttggacatgatatttgtgctcaattgaatgataagttaggttttaatgtagatttgccgtttgttgagtacaaagtaacagtctggcctgtagctactggtgatgttgttttggcatctgatgatttatatgtgaaacgttattttaaaggatgtgaaacttttggtaagcctgttatttggttttgtcatgatgaagcatcattgaattctcttacttattttaataaacctagttttaaatctgaaaatagatatagtgttttgtctgttgattctgtatctgaggagtcacaaggtaatgtggttacttctgttatggaatcgcagattagtactaaagaggttaagttaaagggtgttagaaagactgttaaaatagaagatgctattattgttaatgatgaaaatagttctattaaggttgttaaaagtttatctttagttgatgtttgggatatgtatttgacaggttgtgattatgttgtttgggttgctaatgaattgtcacgcctagttaaatcaccaacagttagggaatatatacgatatggtattaaacctattactatacctatagatttgttatgtttaagagatgataatcaaactcttttagttcctaaaatttttaaagcaagagctatagaattttatggttttttgaagtggttgtttatttatgtttttagtttattacattttacaaatgataaaaccattttttatactacagaaatagcttctaagtttacttttaatttgttttgtttggctcttaaaaatgcttttcagacatttagatggagtatatttataaaaggttttcttgttgtagccactgtgtttttgttttggtttaattttttgtatataaatgttatttttagtgacttttatcttcctaatattagtgtttttcctatttttgtgggaagaattgttatgtggataaaggctacttttggtttggttacaatttgtgatttttattctaagttaggtgtaggttttacaagtcatttttgtaatggtagttttatatgtgaattgtgtcattctggttttgatatgttggatacatatgcagctatagattttgttcagtatgaagtagatagacgtgttttatttgattatgttagtttagtcaaattaattgttgaactcgttattggttattcattatacacagtatggttttatccattattttgtcttattggtttacaattatttactacatggttgcctgatttgtttatgttagaaactatgcattggttgattagatttattgtatttgtagctaatatgttacctgcttttgtcttgttgcggttttatatagttgttactgctatgtataaagtagttggttttattaggcatattgtctatggttgtaataaagctggttgtttattttgttataaacgaaattgtagtgttcgtgttaagtgtagtactattgttggtggtgtaattcgttattatgatattactgctaatggtggtactggtttttgtgttaaacatcaatggaattgttttaattgccattcttttaaaccaggtaacacttttataactgtagaagctgctatagaactttctaaagagcttaaacgacctgtaaatccaactgatgcttcacattatgtagttactgatattaagcaagttggttgtatgatgcgtttgttctatgatagagatggacagcgtgtttacgatgatgttgatgctagtttatttgtagatattaataatctgttacattctaaagttaaagttgttcctaatttgtatgtagttgtagtagagagtgatgctgatagagctaattttctgaatgctgttgtgttttatgcacaatcattgtataggcctatattacttgtagacaaaaagttaattactacagcttgtaatggtatctctgtaacccagactatgtttgatgtttatgttgatacttttatgtctcattttgatgttgatagaaagagttttaataattttgttaacattgctcatgcttctcttagagagggtgtgcaattagaaaaggttttagatacttttgtgggatgtgtacgtaaatgttgttccattgattcagatgttgaaacaagatttattactaaatctatgatatctgcagtagctgctggtttggaatttactgatgaaaattataacaatttggtacctacatatttaaagagtgataatattgtagctgctgatttaggtgttcttatacagaatggtgctaagcatgtacagggtaatgttgctaaggcagctaatatttcttgtatatggtttattgatgcttttaatcaacttactgctgatttacagcataaattaaaaaaagcatgtgttaaaactggcttgaagttaaaattgacttttaataagcaagaggcaagtgtccctattcttacaacacccttttcacttaaaggaggtgttgtattgagtaatttgttatatatattattttttgttagtttaatctgttttatattattgtgggctttattgcctacatatagtgtttataagtctgatattcatttgcctgcttatgctagttttaaagttattgataatggtgttgttagagatatttcagttaatgatttatgttttgctaataaatttttccaatttgatcaatggtatgagtccacttttgggtctgtttactatcataattctatggattgccctattgtagtggcagttatggatgaagatatcggttctactatgtttaatgttcctactaaagttttgagacatggctttcatgttttacattttttaacttatgcatttgctagtgatagtgttcagtgctatacaccacatattcagatttcttataatgatttttatgctagtggttgtgttttatcatctttgtgtactatgtttaaaagaggtgatggtacaccacatccttattgttattcagatggtgttatgaagaatgcttctttgtatacatctttggttccacatacacgttatagccttgctaattctaatggttttataagatttcctgatgttattagtgaaggtattgtacgtattgtaagaacgcgctctatgacttattgtagagtgggtgcatgtgaatacgccgaagagggtatatgttttaattttaatagttcctgggttttgaataatgattattatagaagtatgcctggaactttttgtggtagagatctttttgatttgttttatcaattttttagtagtttaattcgtcctatagatttcttttctcttactgctagttctatttttggagctatattggctatagttgttgtcttggttttttattatttaataaaacttaagcgtgcttttggagattatactagtgttgtagttataaatgttgttgtttggtgtattaattttcttatgctttttgtttttcaagtttatcctatttgtgcatgtgtttatgcttgtttttatttttatgtaacattgtattttccttctgaaattagtgtaattatgcatttgcaatggattgttatgtatggtgctataatgcctttttggttttgtgtcacatatgtagctatggttattgcaaaccatgttttatggttattttcatattgtaggaaaattggtgttaatgtatgtagtgatagtacatttgaagaaacatctcttactacttttatgattactaaagattcttattgtagattaaagaattctgtttctgatgttgcctacaatagatatttgagtttgtataataagtatcgttactatagtggtaaaatggatactgctgcctatagagaagcggcgtgttctcagttagctaaagctatggaaacatttaatcacaataatggtaatgatgtcttataccaacctcctacagcatctgtttctacatcttttttgcaatcaggtattgtaaagatggtatctcctacgtcaaaaattgaaccttgtattgttagtgttacttatggtagtatgactttgaatggtttatggttagatgacaaagtttattgtcctcgtcatgttatatgttcatcctctaatatgaacgaacctgattattctgccttattgtgtagagttactctaggtgattttactataatgtctggtcggatgagtttaacagttgtgtcttaccagatgcagggctgtcaacttgttttgacagtctctttacaaaatccttacactccaaaatatacttttggtaatgttaaacctggtgaaacttttactgttttagctgcgtataatggccgaccacaaggggcatttcatgttactatgcgtagtagttatactattaaaggttcttttttgtgtgggtcatgtggatctgttggttatgtattaacaggtgatagtgttaagtttgtatatatgcatcaattagagctcagtactggttgtcacactggcactgattttactggtaatttttatggtccatatagagatgctcaagttgtacagttgccagttaaggactacgtccagactgttaatgttattgcttggctctatgcagctatacttaataattgtgcttggtttgtacaaaatgatgtttgttctactgaagattttaatgtttgggctatggcaaatggttttagccaagtaaaagcagatcttgtcttagatgctttggcttcaatgacaggtgtttctattgaaactttattggctgctattaagcgtctatatatgggatttcaaggtcgtcaaatactaggaagttgtacttttgaagatgaattggcaccttctgacgtttatcaacaattggctggtgttaaattgcaatctaaaacaaaaagatttattaaagaaacaatttattggattttgatatctacatttttgtttagttgtataatttctgcatttgttaaatggactatatttatgtatattaatacacatatgattggtgttacattatgtgtactttgttttgttagttttatgatgttactagttaaacataagcatttttatttgactatgtatataattcctgtactctgtaccttgttttatgtaaattatttagttgtttataaggaaggttttagaggttttacttatgtctggctctcatattttgttcctgctgtgaattttacttatgtttatgaagtattttatggttgtattttatgtgtttttgctatttttataactatgcatagtattaatcatgacattttttctttgatgtttttggttggtagaatagttactttaatttctatgtggtattttgggtcgaatttagaagaggatgttttgttatttattacagcctttttaggtacttatacatggaccactattttgtcattagctatagcaaaaattgttgctaattggttgtctgttaatatattttattttacagatgtaccttatattaaattgattctcttgagttacttatttatagggtatattttatcttgttattggggatttttctctcttttaaacagtgtttttagaatgcctatgggtgtttataattataaaatttctgttcaagaattgcgttatatgaatgctaatggcttacgtccacctcgtaatagttttgaggctattttgttaaatttaaaactgcttggaataggtggcgtgccagttattgaagtctcccaaattcaatcaaaattgactgatgtgaaatgtgctaatgttgttttgttaaattgtttacagcatttgcatgttgcttctaattctaagttgtggcagtattgtagtgttttacataatgaaatactatctacttcagatttgagtgtagcttttgataagcttgctcaattattgattgttttattcgccaatcctgctgcagttgatactaagtgtcttgcaagtatagatgaagttagcgatgattatgttcaagatagtaccgttttgcaggctttgcaaagtgagtttgtaaatatggctagttttgttgaatatgaagtcgcaaagaaaaatttggctgatgctaaaaatagtggttctgttaatcaacaacagataaaacagttagaaaaagcatgtaatatagctaagtctgtgtatgaacgtgataaagctgtagctcgcaaacttgaacgtatggcagacctagcacttactaacatgtataaagaggctcggattaatgataagaagagtaaagttgtttccgctttgcagacaatgctttttagcatggttcgtaaattggataatcaggctttaaattctattctggataatgctgttaaaggttgtgtacctttgagtgctattccagcattggctgctaatactttaactatagtaataccagataaacaagtttttgataaagttgttgataatgtttatgttacatatgctggtagtgtatggcatatacagactgttcaagatgctgatggtattaataaacagttaactgatattagtgttgattctaattggcctcttgttatcattgcgaacaggtataatgaagttgctaatgctgttatgcagaataatgagttgatgcctcataaattaaaaatacaagttgttaatagtggttctgatatgaattgtaatattcctactcaatgttattataataatggtagtagtggtagaatagtttatgctgttcttagtgatgttgatggtcttaagtatactaagataatgaaagatgatggaaattgtgttgttttagagcttgatcctccttgtaaattttctatacaagatgttaagggacttaaaattaagtatctttattttattaaaggatgtaacactttagctagagggtgggttgttggtactttatcttcaacaattagattgcaggctggtgttgctactgagtatgcagctaattcttctatactttcattatgtgcattttctgtagatcctaagaaaacttatttagattatatacaacaaggtggtgtacctataattaattgtgttaaaatgctctgtgatcatgctggtactggtatggccattactattaaacctgaggctactattaaccaagattcttatggtggtgcctcagtttgtatttattgccgtgcacgtgtagagcatccagatgtagatggtatatgtaaattacgtggtaaatttgtacaagtccctttgggtataaaagatcctattctttatgtgttaacacatgatgtttgtcaagtctgtggtttttggagagatggcagttgttcctgtgtaggttcaagtgtcgctgttcaatctaaagatttaaattttttaaacgggttcggggtactagtgtgaatgcccggctagtaccctgtgctagtggtttatctactgatgttcaattaagggcatttgacatttgtaataccaatagagctggtataggtttatattataaagtgaattgttgccgttttcagcgtatagatgacgacggtaataaattggataagttctttgttgtcaaaagaactaatttagaagtttataataaagagaaaacttattatgagttgactaaaagttgtggtgttgtggctgaacatgatttctttacatttgatattgatggtagtcgcgtgccacatatagttcgtaggaatctttcaaagtatactatgttagatctttgctatgcattgcgtcattttgatcgtaatgattgttcaatattgtgtgaaattctttgtgagtatgctgattgtaaagaatcctacttttctaagaaagattggtatgattttgttgaaaatcctgatattattaatatatataaaaaattaggccctatttttaatagagctttacttaatactgtcatttttgcagacaccttagttgaagtaggtttagttggtgttttaactttagataaccaagatttgtatggtcaatggtatgattttggtgattttatacaaacagccccagggtttggtgtggcagttgcagattcttactattcttatatgatgcctatgttgactatgtgtcatgtattagattgtgaattatttgttaatgatagttatagacaattcgatcttgtacagtatgattttactgattacaagttagagttgtttaataagtattttaagtattggggtatgaagtatcatcctaatactgtggattgtgataatgataggtgtattattcattgtgctaattttaatatactatttagtatggttttacctaatacttgttttggtccccttgttagacaaatttttgtagatggtgtaccgtttgttgtttctattggttaccattacaaagagttaggtgtagttatgaacttagatgttgacacacaccgttatcgtttgtctcttaaagatttacttctttatgcagcagatcctgctatgcacgttgcatctgctagtgctctgcttgatttacgaacttgttgttttagtgtagctgccattacaagtggtataaaatttcaaactgtaaaaccaggtaactttaaccaagacttttacgagtttgttaaaagtaaaggcttgtttaaagagggtagtacagttgatttgaaacattttttctttactcaagatggtaatgctgcaattactgattataattattataagtataatttacctactatggttgatattaagcagttattgtttgtattagaagttgtttataaatattttgaaatttatgatggtggttgtataccagcatcacaagttattgttaataattatgataaaagtgctggttatccatttaataaatttggtaaagccagactttattatgaggcattatcatttgaggaacagaatgaaatttatgcatatactaaacgtaatgttctgcccaccttaactcaaatgaatttaaaatatgctatcagtgctaagaatagagctcgcactgtagcaggtgtttctattcttagtactatgacaggccgaatgttccatcaaaaatgtttgaagagtatagcagctacccgaggtgttcctgttgttataggaaccactaaattttatggtggttgggacgatatgttacgtcatcttataaaggatgttgacaaccctgttcttatgggttgggattatcctaaatgtgatcgtgctatgccaaatattttgcgtattgttagtagtttagttttggcccgcaaacatgaattttgttgttcacatggtgatagattttatcgccttgcgaatgaatgtgctcaagttttgagtgaaatagttatgtgtggcggttgctattatgttaagcctggtggtactagcagtggtgatgcaactactgcttttgctaattctgtttttaatatatgtcaggctgttactgctaatgtttgttctcttatggcctgtaatggccataagattgaagatttaagtatacgcaatttacaaaaacgcttatactctaatgtttatcgtacagattatgttgattatacatttgttaatgagtattatgaatttttatgtaagcattttagtatgatgattttgagtgatgatggtgttgtctgttataactctgattatgctagtaagggttatatagctaatataagtgtttttcaacaagttttgtactatcagaataatgtctttatgtctgaatctaaatgttgggttgaaaatgatattactaatggtcctcatgaattttgttcccaacatactatgttagttaagatagatggtgattatgtttatttaccatatccagatccttctagaattttaggagctggttgttttgttgatgatttattgaagactgacagtgttcttttgatagagcgctttgtaagtctagctatagatgcttaccctttagtacatcatgaaaatgaagaataccaaaaagtctttcgtgtatatttagaatatataaaaaaactgtataatgatcttggtactcagatcttagatagttatagtgttattttaagtacttgtgatggtttaaagtttactgaagaatcattttacaagaatatgtatttaaaaagtgccgtgatgcagagtgtaggtgcatgcgttgtttgttcatcacaaacttctttgcgttgtggcagttgtatacgtaagcctttgttatgttgtaaatgttgttatgaccatgttatggcaactaatcataaatatgttttgagtgtctcaccttacgtttgtaatgcacctaactgtgatgtgagtgatgtcaccaaattatatttgggcggtatgtcttactattgtgaaaaccataaaccccattattcatttaagttagttatgaatggtatggtctttggtttgtataaacaatcttgcacgggttcaccttatatagatgattttaataagatagctagttgtaaatggacagaagttgatgattatgttctggcaaatgagtgtattgaacgtttaaagttatttgctgcagaaactcaaaaggcaactgaagaggcttttaaacaaagctatgcttctgctaccattcaagagattgttagtgatagagaagttattttgtgttgggagacaggtaaagttaaaccaccacttaataaaaattatgttttcacaggctaccattttactagtactggtaagacagttttaggtgagtatgtttttgataaaagtgaattaactaacggtgtgtattaccgcgctacaactacttataaactttctataggtgatgtttttgttttaacatcacattctgtagctagtttaagtgcacctacacttgtcccacaagagaactatgctagtataagattttctagtgtttatagtgttccattggtgtttcaaaataatgttgctaattatcagcacattggaatgaaacgttattgcactgttcaaggtccccctggtacgggaaagtctcatcttgctataggtctagctgtttattactacacagcacgtgtagtttatactgctgctagtcatgctgctgtagatgcattgtgtgaaaaagcttataagtttttaaatattaacgattgtacacgtattattcctgctaaagttcgtgtagattgttatgataagtttaaaattaatgataccacttgtaagtatgtttttaccacaataaatgcattaccagagttggttacagatattgttgttgttgatgaagttagtatgcttactaattatgaattgtctgttataaatgctcgtattaaagctaaacattatgtatatattggagatcctgctcaattacctgcaccacgtgtgctgttgagcaagggttctttagaacctaggcacttcaattctattactaaaataatgtgttgtttaggtcctgatatctttttgggaaattgttataggtgtcctaaagaaattgtagaaactgtttcagcattggtttatgataataaactcaaggctaaaaatgataatagttcattatgttttaaagtatattttaagggacagacaacacatgagagttcaagtgctgtaaatattcaacagatatatctaattagtaaatttttaaaagctaatccagtttggaatagtgctgtttttattagtccttataatagtcagaattatgttgctaagcgtgttttaggtgttcaaacacaaactgtagattctgctcaaggttcggaatatgattatgttatatattcacaaacagcagaaacagcccattctgttaatgttaatcgatttaatgttgccataactagagccaagaagggcattttttgtgttatgagtaatatgcaattatttgaatctcttaattttattactctacctttagataaaattcaaaatcaaactttacctcgtttgcattgcacaactaatctttttaaagattgtagtaaaagttgcttaggttatcatccagcgcatgccccctcatttttagcagttgatgataaatataaggttaatgaaaatttggctgtaaatttaaatatttgtgaacctgttttaacatattctcgtttaatatctcttatgggttttaaattagatttgactcttgatggttattctaaattgtttattactaaagatgaagccattaaacgtgttagaggttgggttggttttgatgttgagggcgctcatgctactcgcgaaaacattggaacaaactttccactgcaaataggtttttcaactggtgtggattttgtagttgaagctactggcttatttgctgagagagattgttatacttttaaaaaaactgtagctaaagctcctcctggtgaaaaatttaaacatttaataccccttatgtcaaaaggtcaaaagtgggatattgttagaattagaattgttcaaatgttatctgattatcttttagacctttctgatagtgtagtatttattacttggtctgccagttttgaacttacttgtttaaggtattttgctaaattaggcagagagcttaattgtaatgtgtgttctaatcgtgctacatgctacaattctagaactggttattatggttgttggcgccatagttatacttgtgattatgtgtataatccacttattgtagatatacaacagtggggttatacaggttctttaactagtaatcacgatataatttgtaatgtacataaaggtgcacatgttgcgtcagctgatgcaattatgactcgttgtttagcaatctatgattgtttttgtaaatctgttaattggaatttagagtatccaataatttctaatgaggtcagtataaatacatcttgtaggttattgcagcgtgtcatgcttaaagctgccatgctatgtaatagatacaacttatgttatgacataggcaatcctaaaggtttagcttgtgtcaaagattatgaatttaaattttatgatgcttttcctgtagccaagtctgttaaacagttattttatgtctatgatgtgcataaagataattttaaagatggtttatgtatgttttggaattgtaatgttgataaatatccatctaattcaattgtttgtagatttgacactcgagtgttaaataaattaaaccttcctggatgtaatggtggtagtttgtatgttaataaacatgcattccatactaatccttttactagaactgtttttgaaaatcttaagcctatgccttttttctattattcagatacgccttgtgtgtacgtagatggtttagaatctaaacaagttgattacgttcctttaagaagcgccacttgtatcacacggtgtaatctaggtggagctgtttgttcaaagcatgctgaagaatattgtaactaccttgagtcttataatatagttactacagcaggctttactttttgggtttataagaattttgatttttataatttatggaacacttttactacgttacagagtttagaaaacgtaatatataacttggttaatgttggtcattatgatggacgtacaggtgaattaccttgtgctattatgaatgacaaagttgttgttaagattaataatgtagatactgttatttttaaaaataatacatcatttcctactaatatagctgttgaattgtttacaaaacgtagtatccggcaccaccctgaacttaagattcttagaaatttgaacattgatatttgttggaagcatgtcctgtgggattatgttaaagatagtttgttttgtagttccacttatggtgtttgtaaatacacagatttgaagttcatcgaaaatttgaatatactttttgatggtcgtgacactggcgctttagaagcttttagaaaagcaagaaatggtgtttttattagtactgaaaaattaagtaggttatcaatgattaaaggtccgcaacgagctgatttaaatggtgtgattgtggataaagttggagaactcaaagttgagttttggttcgctatgagaaaagatggtgacgatgttatcttcagccgaacagacagcctatgctcaagccattactggagcccacaaggtaatctaggtggtaattgcgcgggtaatgtcattggtaatgatgctctaacacgttttactatctttactcagagtcgtgtattgtcaagttttgaacctcgctcagatttagaacgggattttattgatatggatgataatctgtttattgctaaatatggtttagaagactatgcatttgatcatatagtttatggtagttttaaccataaagttataggaggtttgcatttgcttataggcttatttcgtaggaaaaaaaaatctaatttgttaattcaagagtttttacagtatgattctagtattcattcatattttattactgatcaggagtgtggtagtagtaagagtgtttgtacagttattgatttattattagatgattttgtttctattgttaagtcattaaatttgagttgtgttagtaaagttgttaatattaatgttgattttaaggattttcaatttatgttgtggtgtaatgataataaaattatgactttttatcctaaaatgcaagccactaatgattggaaacctggctattctatgcctgttttgtataagtatttgaatgttccattagagagagtctctttatggaattatggtaaacctattaatttgcctacaggctgtatgatgaatgttgctaagtacactcaattatgtcagtatttgaatactacaacattagctgttcctgttaatatgcgtgttttacatttaggtgcagggtctgataaagaagtagctccaggttctgctgttttaagacagtggttaccatctggtagtattcttgtagataatgatttaaacccatttgttagcgatagtttagttacttattttggagattgtatgactttaccatttgattgtcattgggatttgataatatctgatatgtatgatcctcttactaaaaatattggtgattataatgtgagtaaggatgggttttttacttacatttgtcatttaattcgtgataaattatctttgggtggtagtgtagctataaaaattacagagttttcttggaatgctgatttatataaattaatgagttgttttgcattttggacagttttttgtactaatgtaaatgcttcttctagtgaagggtttttaataggtataaattacctgggtaaatcttcttttgaaatagatggcaatgttatgcatgctaactatttgttttggagaaatagtacaacatggaatggcggtgcttatagtttatttgatatgactaaattttctttgaaattggctggcactgctgttgttaatttaagaccagatcaattaaatgatttagtttattctcttattgaaagaggtaaattattagttcgcgatacgcgtaaagagatttttgttggtgatagtcttgtaaatacttgttagatctcattaaatctaaactatgttaattatttttttatttttttatttctgttatggttttaatgaacctcttaatgttgtgtctcatttaaaccatgactggtttttatttggtgatagtcgttctgattgtaaccatattaataatttaaaaattaaaaattttgattatttggatattcaccctagtttgtgcaacaatggtaagatttcatctagtgccggtgattctatttttaagagttttcatttcactcgattttataattacactggcgaaggtgatcaaattattttttatgagggtgttaattttaatccttatcatagatttaagtgttttcctaatggtagtaatgatgtatggcttcttaacaaggtaagattttatcgtgccttatattctaatatggccttttttcgttatcttacttttgttgatattccttataatgtttctctttctaagtttaattcttgtaaaagtgatattttatcacttaacaatcctatttttattaattattctaaggaagtttattttactttattaggttgttctctttatttagtaccgctttgcctttttaaatctaactttagtcagtactattataacatagatactggctctgtttatggtttttctaatgttgtttatcctgatttagactgtatttatatttctcttaaaccaggttcttataaagtttccaccactgcaccttttttatccttacctactaaagctctctgttttgataaatctaaacaatttgtacctgtacaggttgttgattctagatggaacaacgagcgtgcctcagatatttctttatctgttgcatgtcaattgccatattgttattttcgcaattcttctgctaattatgttggcaagtatgatattaaccacggtgatagtggttttatttctattttatctggtcttttatataatgtttcttgtatttcatattatggtgtatttttatatgataattttacatccatttggccctattattcttttggtaggtgtcctacatcttctattattaaacatccaatttgtgtttatgattttttgcctattattttacaaggtattttattatgtttagctttactttttgttgtttttctattatttttgttatataacgataaatctcattaaatctaaacatgttattaattatttttattttgcctacaacattagctgttataggtgattttaattgtactaattttgctattaatgatttaaacaccacagttcctcgcataagtgagtatgttgtggatgtttcttatggtttgggtacatattatatacttgatcgtgtttatttaaatactactatattatttactggttatttccctaaatctggtgccaattttagggatctatctttaaaaggtactacatatttgagtactctttggtatcagaaaccctttttatctgattttaataatggtattttttctagagttaagaatactaagttgtatgttaataaaactttgtatagtgagtttagtactatagttataggtagtgtttttattaacaactcttatactattgttgttcaacctcataatggtgttttggagattacagcttgtcaatacactatgtgtgagtatcctcatactatttgtaaatctaaaggtagttctcgtaatgaatcttggcattttgataaatctgaacctttgtgtctgttcaagaaaaattttacttataatgtttctacagattggttgtattttcatttttatcaagaacgtggcactttttatgcttattatgctgattctggcatgcctactacttttttatttagtttgtatcttggtactcttttatctcattattatgttttgcctttgacttgtaatgctatatcttctaatactgataatgagactttacaatattgggtcacacctttgtctaaacgccaatatcttcttaaatttgacaaccgtggtgttattactaatgctgttgattgttctagtagtttctttagcgagattcaatgtaaaactaaatctttattacctaatactggtgtttatgacttatctggttttactgttaagcctgttgcaactgtacatcgtcgtattcctgatttacctgattgtgacattgataaatggcttaacaattttaatgtaccctcacctcttaattgggaacgtaaaattttttctaattgcaactttaatttgagtactttgcttcgtttagttcatactgattctttttcttgtaataattttgatgaatctaagatatatggtagttgttttaagagtattgttttagataaatttgccatacccaactccagacgatctgatttgcagttgggcagttctggttttctgcaatcttctaattataaaattgacactacttctagttcttgtcaattgtattatagtttgcctgcaattaatgttactattaataattataatccttcttcttggaatagaaggtatggttttaataattttaatttgagctctcatagtgttgtttactcacgttattgtttttctgttaataatactttttgtccttgtgctaaaccttcttttgcttcaagttgcaagagtcataaaccaccttctgcttcctgtcctattggtactaattatcgttcttgtgagagtactactgtactcgaccacactgactggtgtaggtgttcttgtttacctgatcctataactgcttatgaccctaggtcttgttctcaaaaaaagtctctggttggtgttggtgaacattgtgcagggttcggtgttgatgaagaaaagtgtggtgtattggatggatcatataatgtttcttgtctttgtagtactgatgcctttctaggttggtcttatgacacttgcgtcagtaacaaccgttgtaatattttttctaattttattttaaatggtatcaatagtggtaccacttgttctaatgatttattgcagcctaatactgaagtttttactgatgtttgtgttgattacgacctttatggtattacaggacaaggtatttttaaagaagtttctgctgtttattataatagttggcaaaatcttttgtatgattctaatggcaacattattggttttaaagattttgttactaataaaacatataatattttcccttgttatgcaggaagagtttctgctgcttttcatcaaaatgcttcctctttggctttactttatcgtaatttaaaatgtagctatgttttgaataatatttctttaactactcagccatattttgatagttatcttggttgcgtttttaatgctgataatttaactgattattctgtttcttcttgtgctcttcgcatgggtagtggtttttgtgttgattataactcaccttcttcttcctcttcgcgtcgtaaacgtagaagtatttctgcttcttatcgttttgttacttttgaaccctttaatgtcagttttgttaatgacagtattgagtctgtgggtggtctttatgagatcaaaattcccactaactttactatagttggtcaagaggaatttattcaaactaattctcctaaagttactattgattgttctttatttgtctgttctaattatgcagcttgccatgacttattgtcagagtatggcactttttgtgataatattaatagtattttagatgaagttaatggtttacttgatactactcaattgcatgtagctgatactcttatgcaaggtgtcacacttagctccaatcttaatactaatttgcattttgatgttgataatattaattttaaatccctagttggatgtttaggtccacactgcggttcttcttctcgttctttttttgaagatttattgtttgacaaagttaaactttcagatgttggttttgttgaagcttataacaattgtactggtggtagtgaaattagagatcttctttgtgtacaatcctttaatggtattaaagttttgcctcctattttgtctgaatctcaaatttctggttacaccacagccgctactgttgctgctatgtttccaccatggtcagcagcagctggcataccattttctcttaatgtacaatatagaattaatggtttgggtgttactatggatgttcttaataaaaatcaaaagttgatagctactgcttttaataatgctcttctttctattcagaatggttttagtgctaccaactctgcacttgctaaaatacaaagtgttgttaattctaatgctcaagcacttaatagtttgttacagcaattatttaataaatttggtgcaattagttcttctttacaagaaattttatctcgtctcgatgctttagaggctcaggttcagattgataggcttattaatggtcgtttaactgctttaaatgcttatgtctctcaacagcttagtgatatttctcttgtaaaatttggtgctgctttagctatggagaaggttaatgagtgtgttaaaagtcaatctcctcgtattaatttttgtggtaatggtaatcatattttgtcattagttcaaaatgctccttatggtttgttgtttatgcattttagttataaacctatttcttttaaaactgttttagtaagtcctggtttgtgtatatcaggtgatgtaggtattgcacctaaacaagggtattttattaaacataatgatcattggatgttcactggtagttcttactattatcctgaaccaatttcagataaaaatgttgtttttatgaatacttgttctgttaattttactaaagcgcctcttgtttatttgaatcattctgtaccaaaattgtctgattttgaatctgagttatctcattggtttaaaaatcaaacatccattgcgcctaatttgactttaaatcttcatactattaatgctacttttttagatttgtattatgagatgaatcttattcaagagtctattaagtctttgaataatagttatatcaatcttaaagatataggtacatatgaaatgtatgtaaaatggccttggtatgtttggctactaatttctttttcatttataatattccttgtattgctcttttttatatgttgttgtactggttgtggttctgcatgttttagtaaatgtcataattgttgtgatgagtatggtggtcatcatgattttgttatcaaaacatctcatgatgattagaatctcttgtcagatctcattaaatctaaactttatttatggacgtttggagacctagctacacacattctcttgttattagagaatttggtgttacaaaccttgaagatttgtgtctaaagtataattactgtcaacctattgttggttactgtattgtacctttaaatgtttggtgtcgcaagtttggcaaatttgcttctcactttacattacgtagtcacgatatttcccatagtaataattttggtgttgtaactagttttactacttatggtaatactgtttctgaggctgtgtctagattagttgaatcagcttctgaatttattgtttggcgtgcagaggcacttaataagtatggttgatttatttttcaatgatactgcttggtacataggacagattttagttttagttttattttgtcttatttctttaatctttgttgttgcttttttagcaactattaagctttgtatgcaactttgtggtttttgtaatttctttattatttcaccttcggcttacgtttataaaagaggtatgcagttgtataagtcttatagtgaacaagttataccacccacttcagattatttaatctaaatctaaacattatgaataaatcttttcttcctcaatttacttctgatcaagctgttacattcttaaaagaatggaatttctctttgggtgtaatactactttttattactatcatattgcagttcggttatacgagccgtagtatgtttgtttatcttatcaagatgattattctttggcttatgtggccattgactatcaccttgactatatttaattgtttttatgctttgaataatgcttttcttgcattttctatagtgtttactattatttctattgttatatggattctttattttgttaatagtattcggctttttattagaactggcagttggtggagttttaatccagagaccaataatcttatgtgtattgatatgaaaggcaagatgtttgttaggccagttattgaggactatcacacattaactgctactgttattcgtggtcatctttatatacagggtgtcaaacttggcactggttatactctttcagatttgcccgtatatgttactgtagctaaggtgcaagtactttgtacctataaacgtgcctttttagataagttagatgttaatagtggttttgctgtttttgttaagtctaaagttggtaactatcgtttaccgtctagtaaacctagtggtatggatactgccttgttaagagcttaaatctaaactattaggatgtcttatactcccggtcattatgctggaagtagaagctcctctggaaatcgttcaggaatcctcaagaaaacttcttgggctgaccaatctgagcgaaattaccaaacctttaatagaggcagaaaaacccaacctaaattcactgtgtctactcaaccacaaggaaatactatcccacattattcctggttctccgggatcactcaatttcaaaaaggtagagactttaaattttcagatggtcaaggagttcccattgctttcggagtacccccttctgaagcaaaaggatattggtatagacacagccggcgttcttttaaaacagctgatggtcaacaaaagcagttgttaccgagatggtatttctactatctcggtaccggcccatatgccaatgcatcctatggtgaatccctcgaaggggtcttctgggttgctaatcaccaagctgacacttctactccctccgatgtttcgtcaagggatcctactactcaagaagctatccctactaggtttccgcctggtacgattttgcctcaaggctattatgttgaaggctcaggaaggtctgcttctaatagtcgaccaggttcacgttctcaatcacgtggacccaataatcgttcattaagtagaagtaattctaattttagacattcagattctatagtaaaacctgatatggctgatgagatcgctaatcttgttttagccaagcttggtaaagattctaaacctcagcaagtcactaagcaaaatgccaaggaaatcaggcataaaattttaacaaaacctcgccaaaagcgaactcctaataaacattgtaatgttcaacagtgttttggtaaaagaggaccttctcaaaattttggtaatgctgaaatgttaaagcttggtactaatgatcctcagtttcctattcttgcagaattagctcctacaccaggtgcttttttctttggttctaaattagacttggttaaaagagattccgaggctgactcacctgttaaagatgtttttgaacttcattattctggttctattaggtttgatagtactttaccaggctttgagacaattatgaaagttcttgaagagaatttaaatgcttacgttaattctaatcagaacactgattctgattcgttgagttctaaacctcagcgtaaaagaggtgttaaacaattaccagaacagtttgactctcttaatttaagtgctggtactcagcacatttcaaatgattttactcctgaggatcatagtttacttgctactcttgatgatccttatgtagaagactctgttgcttaatgagaatgaatcctaattcgacactaggtggtaacccctcgctattattcggaataggacactctctatcagaatgaattcttgctgtaataacagatagagtaggttgttacagactatatattaattagtagaaattttatatttagacatttgattgttagagtagttataaggtttagctgtagtataaacgcctccgggaagagctatcaattgtagtgtttaatatatatattagtatatgattgaaattaattatagccttttggaggaattacaaaaaaaaaaaaaaaa

SEQ ID NO: 4 - DNA, 23 bp, Artificial Sequence
  Description of Artificial Sequence: Synthetic primer
ggttgggactatcctaagtgtga

SEQ ID NO: 5 - DNA, 24 bp, Artificial Sequence
  Description of Artificial Sequence: Synthetic primer
ccatcatcagatagaatcatcata

SEQ ID NO: 6 - DNA, 38 bp, Artificial Sequence
  Description of Artificial Sequence: Synthetic primer
ttttccttttgcggccgcttaagcaacagagtcttcta

SEQ ID NO: 7 - DNA, 27 bp, Artificial Sequence
  Description of Artificial Sequence: Synthetic primer
cggaattcgatgtcttatactcccggt

SEQ ID NO: 8 - RNA, 22 nt, Corononavirus-HKU1
uuaaaucuaaacuuuuuaaaug

SEQ ID NO: 9 - RNA, 16 nt, Corononavirus-HKU1
uuaaaucuaaacuaug

SEQ ID NO: 10 - RNA, 15 nt, Corononavirus-HKU1
uuaaaucuaaacaug

SEQ ID NO: 11 - RNA, 22 nt, Corononavirus-HKU1
uuaaaucuaaacuuuauuuaug

SEQ ID NO: 12 - RNA, 18 nt, Corononavirus-HKU1
cuaaaucuaaacauuaug

SEQ ID NO: 13 - RNA, 22 nt, Corononavirus-HKU1
uuaaaucuaaacuauuaggaug

SEQ ID NO: 14 - RNA, 44 nt, Corononavirus-HKU1
uuaaaucuaaacuauuaggaugucuuauacucccggucauuaug

SEQ ID NO: 15 - protein, 140 aa, Corononavirus-HKU1
NDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGD

SEQ ID NO: 16 - protein, 10 aa, Corononavirus-HKU1
NNDEEIVTGD

SEQ ID NO: 17 - protein, 10 aa, Corononavirus-HKU1
NDDQIVVTGD

SEQ ID NO: 18 - protein, 4 aa, Corononavirus-HKU1
FGDS

SEQ ID NO: 19 - protein, 5 aa, Corononavirus-HKU1
RRKRR

SEQ ID NO: 20 - protein, 10 aa, Clonorchis sinensis
DGGAQPPKSG

SEQ ID NO: 21 - protein, 344 aa, Human coronavirus-OC43
MFLILLISLPTAFAVIGDLKCTSDTSYINDKDTGPPPISTDTVDVTNGLGTYYVLDRVYLNTTLFLNGYYPTSGSTYRNMALKGSVLLSRLWFKPPFLSDFINGIFAKVKNTKVIKDRVMYSEFPAITIGSTFVNTSYSVVVQPRTINSTQDGYNKLQGLLEVSVCQYNMCEYPQTICHPNLGNHRKELWHLDTGVVSCLYKRNFTYDVNADYLYFHFYQEGGTFYAYFTDTGVVTKFLFNVYLGMALSHYYVMPLTCNSKVKNGFTLEYWVTPLTSRQYLLAFNQDGIIFNAVDCMSDFMSEIKCKTQSIAPPTGVYELNGYTVQPIADVYRRKLNLPNCNIE

SEQ ID NO: 22 - protein, 332 aa, Murine hepatitis virus
MLFVFILFLPSCLGYIGDFRCIQLVNSNGANVSAPSISTETVEVSQGLGTYYVLDRVYLNATLLLTGYYPVDGSKFRNLALTGTNSVSLSWFQPPYLSQFNDGIFAKVQNLKTSTPSGATAYFPTIVIGSLFGYTSYTVVIEPYNGVIMASVCQYTICLLPYTDCKPNTNGNKLIGFWHTDVKPPICVLKRNFTLNVNADAFYFHFYQHGGTFYAYYADKPSATTFLFSVYIGDILTQYYVLPFICNPTAGSTFAPRYWVTPLVKRQYLFNFNQKGVITSAVDCASSYTSEIKCKTQSMLPSTGVYELSGYTVQPVGVVYRRVANLPACNIE

SEQ ID NO: 23 - protein, 332 aa, Rat sialodacryoadenitis encephalitis virus
MLFVFLTLLPSCLGYIGDFRCINLVNTRISNARAPSVSTEVVDVSKGLGTYYVLDRVYLNATLLLTGYYPVDGSMYRNMALMGTNTLSLNWFEPPFLSEFNDGIYAKVKNLKASLPIGSASYFPTIIIGSNFVNTSYTVVLEPYNGIIMASICQYTICQLPHTDCKPNTGGNTLIGFWHTDLRPPVCILKRNFTFNVNAEWLYFHFYQQGGTFYAYYADVSSATTFLFSSYIGAVLTQYFVLPYMCSPTTSGVSSPQYWVTPLVKRQYLFNFNQKGIITSAVDCASSYTSEIKCKTQSMNPNTGVYDLSGYTVQPVGLVYRRVRNLPDCKIE

SEQ ID NO: 24 - protein, 334 aa, Bovine coronavirus
MFLILLISLPTAFAVIGDLKCTTVSINDVDTGVPSISTDTVDVTNGLGTYYVLDRVYLNTTLLLNGYYPTSGSTYRNMALKGTLLLSTLWFKPPFLSDFTNGIFAKVKNTKVIKDGVMYSEFPAITIGSTFVNTSYSVVVQPHTTILGNKLQGFLEISVCQYTMCEYPNTICNPNLGNQRVELWHWDTGVVSCLYKRNFTYDVNADYLYFHFYQEGGTFYAYFTDTGVVTKFLFNVYLGTVLSHYYVMPLTCNSALTLEYWVTPLTSKQYLLAFNQDGVIFNAVDCKSDFMSEIKCKTLSIAPSTGVYELNGYTVQPIADVYRRIPNLPDCNIE

SEQ ID NO: 25 - protein, 334 aa, Porcine hemagglutinating encephalomyelitis virus
MFFILLISLPSAFAVIGDLKCTTSLINDVDTGVPSISSEVVDVTNGLGTFYVLDRVYLNTTLLLNGYYPISGATFRNMALKGTRLLSTLWFKPPFLSPFNDGIFAKVKNSRFSKDGVIYSEFPAITIGSTFVNTSYSIVVEPHTSLINGNLQGLLQISVCQYTMCEYPHTICHPNLGNQRIELWHYDTDVVSCLYRRNFTYDVNADYLYFHFYQEGGTFYAYFTDTGFVTKFLFKLYLGTVLSHYYVMPLTCNSALSLEYWVTPLTTRQFLLAFDQDGVLYHAVDCASDFMSEIMCKTSSITPPTGVYELNGYTVQPVATVYRRIPDLPNCDIE

SEQ ID NO: 26 - protein, 334 aa, Equine coronavirus
MVLLLLFFLPGAFAVVGDVKCTTTGVNNFNSGAPVISTETVDVTNGLGTYYVLDRVYLNTTLLLNGYYPTSGANYRNLALKASGLLSTLWYKPPFLSEFNDGVFAKVKNTKVTKNGIVYSEFPTMAIGTTFVNTSYTVVVQPRTTVVNSKLQGLLEITICQYSMCEYPNTVCNSGIGSPRKELWHYEKAVASCLYRRNFTYDVNSDWLYFHFYQQGGTFYAYYTDSGFITTFLFNIYLGTSLSHYYVMPLSCSGKLDLQYWVTPLTNRQFLLVFNQDGIIYNAVDCASDYMSEIKCNTQNVKPSTGVYDLTGYTVQPIADVYRRIPNLPDCNME

SEQ ID NO: 27 - protein, 6 aa, Artificial Sequence
  Description of Artificial Sequence: Synthetic 6xHis tag
HHHHHH

SEQ ID NO: 28 - protein, 10 aa, Human coronavirus OC43
DYSKNRRSRG

SEQ ID NO: 29 - protein, 10 aa, Murine hepatitis virus
DYSKSRRAHR

SEQ ID NO: 30 - protein, 10 aa, Rat sialodacryoadenitis encephalitis virus
NYSIAHRARR

SEQ ID NO: 31 - protein, 10 aa, Bovine coronavirus
DYSTKRRSRR

SEQ ID NO: 32 - protein, 10 aa, Porcine hemagglutinating encephalomyelitis virus
DYVTALRSRR

SEQ ID NO: 33 - protein, 10 aa, Equine coronavirus
DYSTARRQRR

SEQ ID NO: 34 - DNA, 29942 bp, Corononavirus-HKU1; identical to SEQ ID NO: 3
  CDS (1)..(29940)

SEQ ID NO: 35 - protein, 18 aa, Corononavirus-HKU1
ERIASVPSISLRSLVRSH

SEQ ID NO: 36 - protein, 44 aa, Corononavirus-HKU1
TRFPVIHACECGLIIILYFTFHTFHLSASDVLVVLSVPPIGRND

SEQ ID NO: 37 - protein, 26 aa, Corononavirus-HKU1
NQQIRSRLQVGARISLAASGCSGGVG

SEQ ID NO: 38 - protein, 5 aa, Corononavirus-HKU1
SYEVR

SEQ ID NO: 39 - protein, 18 aa, Corononavirus-HKU1
GWVMPLYWSSDGKCWIRL

SEQ ID NO: 40 - protein, 22 aa, Corononavirus-HKU1
SCEDRLSLHSWTRMACAVKSYP

SEQ ID NO: 41 - protein, 4 aa, Corononavirus-HKU1
YFCS

SEQ ID NO: 42 - protein, 9 aa, Corononavirus-HKU1
RSTCCRSSN

SEQ ID NO: 43 - protein, 11 aa, Corononavirus-HKU1
NSRKVRYGNFN

SEQ ID NO: 44 - protein, 4 aa, Corononavirus-HKU1
ITFA

SEQ ID NO: 45 - protein, 5 aa, Corononavirus-HKU1
LGWFS

SEQ ID NO: 46 - protein, 12 aa, Corononavirus-HKU1
RVCYGLVPFIQD

SEQ ID NO: 47 - protein, 14 aa, Corononavirus-HKU1
TLCCTSSFYDYIYY

SEQ ID NO: 48 - protein, 23 aa, Corononavirus-HKU1
RFFGLDCTFWFYAILCSQMVSIL

SEQ ID NO: 49 - protein, 6 aa, Corononavirus-HKU1
FNNFKF

SEQ ID NO: 50 - protein, 6 aa, Corononavirus-HKU1
CRRCLC

SEQ ID NO: 51 - protein, 9 aa, Corononavirus-HKU1
IFTKSLCFT

SEQ ID NO: 52 - protein, 5 aa, Corononavirus-HKU1
TISWY

SEQ ID NO: 53 - protein, 10 aa, Corononavirus-HKU1
TRTFCRPVWL

SEQ ID NO: 54 - protein, 27 aa, Corononavirus-HKU1
ISRLSSSLWSLFFARYETKAVCMACQL

SEQ ID NO: 55 - protein, 9 aa, Corononavirus-HKU1
YCSGLACSS

SEQ ID NO: 56 - protein, 16 aa, Corononavirus-HKU1
FTICYAPADYSYYLWY

SEQ ID NO: 57 - protein, 17 aa, Corononavirus-HKU1
ICCTTYRRCSRWRCSYT

SEQ ID NO: 58 - protein, 7 aa, Corononavirus-HKU1
TCTFIIC

SEQ ID NO: 59 - protein, 7 aa, Corononavirus-HKU1
CNSFKAS

SEQ ID NO: 60 - protein, 9 aa, Corononavirus-HKU1
FDESYDSYG

SEQ ID NO: 61 - protein, 13 aa, Corononavirus-HKU1
LWFCYAVWLCRLF

SEQ ID NO: 62 - protein, 7 aa, Corononavirus-HKU1
FLWLGFR

SEQ ID NO: 63 - protein, 14 aa, Corononavirus-HKU1
YDGWFFLSIVLYSL

SEQ ID NO: 64 - protein, 8 aa, Corononavirus-HKU1
SPIIWCYS

SEQ ID NO: 65 - protein, 6 aa, Corononavirus-HKU1
KSCVIY

SEQ ID NO: 66 - protein, 26 aa, Corononavirus-HKU1
FVWLFCHTIWFLYILVAASWIVDSYN

SEQ ID NO: 67 - protein, 6 aa, Corononavirus-HKU1
IFSQVL

SEQ ID NO: 68 - protein, 9 aa, Corononavirus-HKU1
FGLFRCSRL

SEQ ID NO: 69 - protein, 16 aa, Corononavirus-HKU1
RNCSYYSCTLLRLCSM

SEQ ID NO: 70 - protein, 7 aa, Corononavirus-HKU1
TKSYSWR

SEQ ID NO: 71 - protein, 4 aa, Corononavirus-HKU1
ATVA

SEQ ID NO: 72 - protein, 6 aa, Corononavirus-HKU1
YASKKY

SEQ ID NO: 73 - protein, 23 aa, Corononavirus-HKU1
FCLQVCSLWRWFCTFFTRWFNSP

SEQ ID NO: 74 - protein, 22 aa, Corononavirus-HKU1
LLSNSEWYFLYIFDVSIFTRSF

SEQ ID NO: 75 - protein, 24 aa, Corononavirus-HKU1
YVFKNVYFVYGQSFSCYILYRALC

SEQ ID NO: 76 - protein, 5 aa, Corononavirus-HKU1
VGYSI

SEQ ID NO: 77 - protein, 7 aa, Corononavirus-HKU1
VIGYYTC

SEQ ID NO: 78 - protein, 5 aa, Corononavirus-HKU1
YHVRC

SEQ ID NO: 79 - protein, 23 aa, Corononavirus-HKU1
CTCYRLASLPIIEWSFCSISSQL

SEQ ID NO: 80 - protein, 6 aa, Corononavirus-HKU1
FCCFNT

SEQ ID NO: 81 - protein, 5 aa, Corononavirus-HKU1
ILHFF

SEQ ID NO: 82 - protein, 8 aa, Corononavirus-HKU1
VIIRVCYS

SEQ ID NO: 83 - protein, 8 aa, Corononavirus-HKU1
CFKRYACS

SEQ ID NO: 84 - protein, 8 aa, Corononavirus-HKU1
WFSLYCRQ

SEQ ID NO: 85 - protein, 11 aa, Corononavirus-HKU1
YRVNSWFCFTM

SEQ ID NO: 86 - protein, 9 aa, Corononavirus-HKU1
CTGTTNLFF

SEQ ID NO: 87 - protein, 10 aa, Corononavirus-HKU1
RRCRICYSRR

SEQ ID NO: 88 - protein, 9 aa, Corononavirus-HKU1
ECQIFFIIL

SEQ ID NO: 89 - protein, 5 aa, Corononavirus-HKU1
VLSTT

SEQ ID NO: 90 - protein, 9 aa, Corononavirus-HKU1
ICRKNLYYR

SEQ ID NO: 91 - protein, 4 aa, Corononavirus-HKU1
YVHG

SEQ ID NO: 92 - protein, 7 aa, Corononavirus-HKU1
IFPYCHE

SEQ ID NO: 93 - protein, 15 aa, Corononavirus-HKU1
KYLSFRSGLAFSMCR

SEQ ID NO: 94 - protein, 14 aa, Corononavirus-HKU1
RETCCYGDSVFDDS

SEQ ID NO: 95 - protein, 5 aa, Corononavirus-HKU1
FRFYF

SEQ ID NO: 96 - protein, 5 aa, Corononavirus-HKU1
SLFRI

SEQ ID NO: 97 - protein, 8 aa, Corononavirus-HKU1
SRKGCYCR

SEQ ID NO: 98 - protein, 6 aa, Corononavirus-HKU1
FCCCCL

SEQ ID NO: 99 - protein, 9 aa, Corononavirus-HKU1
CYRECFKLL

SEQ ID NO: 100 - protein, 14 aa, Corononavirus-HKU1
RASSGWLSSSCIFK

SEQ ID NO: 101 - protein, 6 aa, Corononavirus-HKU1
ECCLFI

SEQ ID NO: 102 - protein, 12 aa, Corononavirus-HKU1
SNGLSYVLYFCY

SEQ ID NO: 103 - protein, 4 aa, Corononavirus-HKU1
RRYQ

SEQ ID NO: 104 - protein, 6 aa, Corononavirus-HKU1
SCRRYY

SEQ ID NO: 105 - protein, 5 aa, Corononavirus-HKU1
RCCYW

SEQ ID NO: 106 - protein, 5 aa, Corononavirus-HKU1
RCCYW

SEQ ID NO: 107 - protein, 5 aa, Corononavirus-HKU1
RCCYW

SEQ ID NO: 108 - protein, 5 aa, Corononavirus-HKU1
RCCYW

SEQ ID NO: 109 - protein, 5 aa, Corononavirus-HKU1
RCCYW

SEQ ID NO: 110 - protein, 5 aa, Corononavirus-HKU1
RCCYW

SEQ ID NO: 111 - protein, 5 aa, Corononavirus-HKU1
RCCYW

SEQ ID NO: 112 - protein, 5 aa, Corononavirus-HKU1
RCCYW

SEQ ID NO: 113 - protein, 5 aa, Corononavirus-HKU1
RCCYW

SEQ ID NO: 114 - protein, 5 aa, Corononavirus-HKU1
RCCYW

SEQ ID NO: 115 - protein, 5 aa, Corononavirus-HKU1
RCCYW

SEQ ID NO: 116 - protein, 5 aa, Corononavirus-HKU1
RCCYW

SEQ ID NO: 117 - protein, 5 aa, Corononavirus-HKU1
RCCYW

SEQ ID NO: 118 - protein, 5 aa, Corononavirus-HKU1
RCCYW

SEQ ID NO: 119 - protein, 5 aa, Corononavirus-HKU1
RDCYW

SEQ ID NO: 120 - protein, 6 aa, Corononavirus-HKU1
PNCCYW

SEQ ID NO: 121 - protein, 5 aa, Corononavirus-HKU1
SSFSF

SEQ ID NO: 122 - protein, 4 aa, Corononavirus-HKU1
CFVC

SEQ ID NO: 123 - protein, 5 aa, Corononavirus-HKU1
NRNIF

SEQ ID NO: 124 - protein, 10 aa, Corononavirus-HKU1
WFMVTYYYTY

SEQ ID NO: 125 - protein, 15 aa, Corononavirus-HKU1
LLVAFCVTCNAEITF

SEQ ID NO: 126 - protein, 4 aa, Corononavirus-HKU1
GFSY

SEQ ID NO: 127 - protein, 6 aa, Corononavirus-HKU1
KYVVIL

SEQ ID NO: 128 - protein, 4 aa, Corononavirus-HKU1
SKFC

SEQ ID NO: 129 - protein, 7 aa, Corononavirus-HKU1
LFTDHYS

SEQ ID NO: 130 - protein, 11 aa, Corononavirus-HKU1
SYCFASRWFCS

SEQ ID NO: 131 - protein, 9 aa, Corononavirus-HKU1
FCLLVFKPV

SEQ ID NO: 132 - protein, 10 aa, Corononavirus-HKU1
LVLFKMWFFF

SEQ ID NO: 133 - protein, 18 aa, Corononavirus-HKU1
FKWFGCFVFLWRYCVSCL

SEQ ID NO: 134 - protein, 17 aa, Corononavirus-HKU1
YDSNSSGLTLYITFFII

SEQ ID NO: 135 - protein, 8 aa, Corononavirus-HKU1
QFLCFLHP

SEQ ID NO: 136 - protein, 21 aa, Corononavirus-HKU1
KNFYCCMCCGCKRLSFCSCYR

SEQ ID NO: 137 - protein, 4 aa, Corononavirus-HKU1
TNRW

SEQ ID NO: 138 - protein, 9 aa, Corononavirus-HKU1
FYSRLWNVI

SEQ ID NO: 139 - protein, 4 aa, Corononavirus-HKU1
YVFF

SEQ ID NO: 140 - protein, 11 aa, Corononavirus-HKU1
VTSIVWFVYNT

SEQ ID NO: 141 - protein, 4 aa, Corononavirus-HKU1
CMFC

SEQ ID NO: 142 - protein, 5 aa, Corononavirus-HKU1
YYKCC

SEQ ID NO: 143 - protein, 18 aa, Corononavirus-HKU1
WAYAPWWWSCKSYSCSCR

SEQ ID NO: 144 - protein, 6 aa, Corononavirus-HKU1
RNCCYG

SEQ ID NO: 145 - protein, 14 aa, Corononavirus-HKU1
RCLPSRRLLCFYRW

SEQ ID NO: 146 - protein, 4 aa, Corononavirus-HKU1
YCRP

SEQ ID NO: 147 - protein, 14 aa, Corononavirus-HKU1
TRWKTILCFVSTCL

SEQ ID NO: 148 - protein, 12 aa, Corononavirus-HKU1
LLFVYSHIGWYI

SEQ ID NO: 149 - protein, 10 aa, Corononavirus-HKU1
CVINLPSRCC

SEQ ID NO: 150 - protein, 5 aa, Corononavirus-HKU1
TSYPC

SEQ ID NO: 151 - protein, 13 aa, Corononavirus-HKU1
YYSKMSNYFSCWY

SEQ ID NO: 152 - protein, 4 aa, Corononavirus-HKU1
SIGC

SEQ ID NO: 153 - protein, 5 aa, Corononavirus-HKU1
CRPCY

SEQ ID NO: 154 - protein, 10 aa, Corononavirus-HKU1
DRCIQTFFEW

SEQ ID NO: 155 - protein, 17 aa, Corononavirus-HKU1
LFCFKFFCYTRSFIASS

SEQ ID NO: 156 - protein, 4 aa, Corononavirus-HKU1
YTIE

SEQ ID NO: 157 - protein, 4 aa, Corononavirus-HKU1
LFVV

SEQ ID NO: 158 - protein, 6 aa, Corononavirus-HKU1
RLASYQ

SEQ ID NO: 159 - protein, 5 aa, Corononavirus-HKU1
FYLYM

SEQ ID NO: 160 - protein, 6 aa, Corononavirus-HKU1
RLWLCM

SEQ ID NO: 161 - protein, 4 aa, Corononavirus-HKU1
WFFL

SEQ ID NO: 162 - protein, 7 aa, Corononavirus-HKU1
SSLCFIS

SEQ ID NO: 163 - protein, 11 aa, Corononavirus-HKU1
EDRCFAYCRWC

SEQ ID NO: 164 - protein, 7 aa, Corononavirus-HKU1
IYFSYCR

SEQ ID NO: 165 - protein, 4 aa, Corononavirus-HKU1
FLCR

SEQ ID NO: 166 - protein, 5 aa, Corononavirus-HKU1
NFISV

SEQ ID NO: 167 - protein, 5 aa, Corononavirus-HKU1
KFVFS

SEQ ID NO: 168 - protein, 10 aa, Corononavirus-HKU1
YFCCTKFIWV

SEQ ID NO: 169 - protein, 8 aa, Corononavirus-HKU1
SATIACLL

SEQ ID NO: 170 - protein, 5 aa, Corononavirus-HKU1
FFNSM

SEQ ID NO: 171 - protein, 5 aa, Corononavirus-HKU1
MVCSC

SEQ ID NO: 172 - protein, 6 aa, Corononavirus-HKU1
RSIFFF

SEQ ID NO: 173 - protein, 13 aa, Corononavirus-HKU1
LLCECSLSYVAAY

SEQ ID NO: 174 - protein, 8 aa, Corononavirus-HKU1
MAVAGSMV

SEQ ID NO: 175 - protein, 7 aa, Corononavirus-HKU1
ISCWQTT

SEQ ID NO: 176 - protein, 7 aa, Corononavirus-HKU1
VSCSCFS

SEQ ID NO: 177 - protein, 5 aa, Corononavirus-HKU1
TIRCY

SEQ ID NO: 178 - protein, 9 aa, Corononavirus-HKU1
FYSCCFETS

SEQ ID NO: 179 - protein, 6 aa, Corononavirus-HKU1
FIRCNL

SEQ ID NO: 180 - protein, 5 aa, Corononavirus-HKU1
IRTYL

SEQ ID NO: 181 - protein, 7 aa, Corononavirus-HKU1
TRKSCWC

SEQ ID NO: 182 - protein, 11 aa, Corononavirus-HKU1
CCYAFWYISKD

SEQ ID NO: 183 - protein, 5 aa, Corononavirus-HKU1
NCPLY

SEQ ID NO: 184 - protein, 9 aa, Corononavirus-HKU1
IECTIFDLF

SEQ ID NO: 185 - protein, 4 aa, Corononavirus-HKU1
YSSE

SEQ ID NO: 186 - protein, 4 aa, Corononavirus-HKU1
CCCS

SEQ ID NO: 187 - protein, 22 aa, Corononavirus-HKU1
HVYGCRCRPLYTFEMWFTLPTL

SEQ ID NO: 188 - protein, 5 aa, Corononavirus-HKU1
KIYRC

SEQ ID NO: 189 - protein, 4 aa, Corononavirus-HKU1
WLFN

SEQ ID NO: 190 - protein, 4 aa, Corononavirus-HKU1
LLVS

SEQ ID NO: 191 - protein, 11 aa, Corononavirus-HKU1
KFNPDFYIYVD

SEQ ID NO: 192 - protein, 4 aa, Corononavirus-HKU1
LFFG

SEQ ID NO: 193 - protein, 4 aa, Corononavirus-HKU1
NGCL

SEQ ID NO: 194 - protein, 6 aa, Corononavirus-HKU1
SFTILL

SEQ ID NO: 195 - protein, 11 aa, Corononavirus-HKU1
VLYKTYYKGSV

SEQ ID NO: 196 - protein, 4 aa, Corononavirus-HKU1
RCLY

SEQ ID NO: 197 - protein, 4 aa, Corononavirus-HKU1
VSWT

SEQ ID NO: 198 - protein, 6 aa, Corononavirus-HKU1
YLCSIE

SEQ ID NO: 199 - protein, 6 aa, Corononavirus-HKU1
CRFAVC

SEQ ID NO: 200 - protein, 11 aa, Corononavirus-HKU1
VQSNSLACSYW

SEQ ID NO: 201 - protein, 5 aa, Corononavirus-HKU1
CCFGI

SEQ ID NO: 202 - protein, 7 aa, Corononavirus-HKU1
FICETLF

SEQ ID NO: 203 - protein, 7 aa, Corononavirus-HKU1
ACYLVLS

SEQ ID NO: 204 - protein, 9 aa, Corononavirus-HKU1
SIIEFSYLF

SEQ ID NO: 205 - protein, 4 aa, Corononavirus-HKU1
CFVC

SEQ ID NO: 206 - protein, 4 aa, Corononavirus-HKU1
GVTR

SEQ ID NO: 207 - protein, 10 aa, Corononavirus-HKU1
CGYFCYGIAD

SEQ ID NO: 208 - protein, 4 aa, Corononavirus-HKU1
VKGC

SEQ ID NO: 209 - protein, 7 aa, Corononavirus-HKU1
NRRCYYC

SEQ ID NO: 210 - protein, 5 aa, Corononavirus-HKU1
KFIFS

SEQ ID NO: 211 - protein, 9 aa, Corononavirus-HKU1
CLGYVFDRL

SEQ ID NO: 212 - protein, 6 aa, Corononavirus-HKU1
LCCLGC

SEQ ID NO: 213 - protein, 5 aa, Corononavirus-HKU1
IVTPS

SEQ ID NO: 214 - protein, 4 aa, Corononavirus-HKU1
ITNS

SEQ ID NO: 215 - protein, 7 aa, Corononavirus-HKU1
GIYTIWY

SEQ ID NO: 216 - protein, 13 aa, Corononavirus-HKU1
TYYYTYRFVMFKR

SEQ ID NO: 217 - protein, 6 aa, Corononavirus-HKU1
SNSFSS

SEQ ID NO: 218 - protein, 18 aa, Corononavirus-HKU1
SKSYRILWFFEVVVYLCF

SEQ ID NO: 219 - protein, 6 aa, Corononavirus-HKU1
FITFYK

SEQ ID NO: 220 - protein, 10 aa, Corononavirus-HKU1
NHFLYYRNSF

SEQ ID NO: 221 - protein, 6 aa, Corononavirus-HKU1
FVLFGS

SEQ ID NO: 222 - protein, 6 aa, Corononavirus-HKU1
KCFSDI

SEQ ID NO: 223 - protein, 19 aa, Corononavirus-HKU1
MEYIYKRFSCCSHCVFVLV

SEQ ID NO: 224 - protein, 8 aa, Corononavirus-HKU1
FFVYKCYF

SEQ ID NO: 225 - protein, 4 aa, Corononavirus-HKU1
LLSS

SEQ ID NO: 226 - protein, 23 aa, Corononavirus-HKU1
CFSYFCGKNCYVDKGYFWFGYNL

SEQ ID NO: 227 - protein, 10 aa, Corononavirus-HKU1
VRCRFYKSFL

SEQ ID NO: 228 - protein, 6 aa, Corononavirus-HKU1
IVSFWF

SEQ ID NO: 229 - protein, 13 aa, Corononavirus-HKU1
YVGYICSYRFCSV

SEQ ID NO: 230 - protein, 4 aa, Corononavirus-HKU1
TCFI

SEQ ID NO: 231 - protein, 6 aa, Corononavirus-HKU1
FSQINC

SEQ ID NO: 232 - protein, 29 aa, Corononavirus-HKU1
TRYWLFIIHSMVLSIILSYWFTIIYYMVA

SEQ ID NO: 233 - protein, 11 aa, Corononavirus-HKU1
FVYVRNYALVD

SEQ ID NO: 234 - protein, 6 aa, Corononavirus-HKU1
IYCICS

SEQ ID NO: 235 - protein, 18 aa, Corononavirus-HKU1
YVTCFCLVAVLYSCYCYV

SEQ ID NO: 236 - protein, 5 aa, Corononavirus-HKU1
SSWFY

SEQ ID NO: 237 - protein, 6 aa, Corononavirus-HKU1
AYCLWL

SEQ ID NO: 238 - protein, 7 aa, Corononavirus-HKU1
SWLFILL

SEQ ID NO: 239 - protein, 10 aa, Corononavirus-HKU1
YYCWWCNSLL

SEQ ID NO: 240 - protein, 7 aa, Corononavirus-HKU1
WWYWFLC

SEQ ID NO: 241 - protein, 6 aa, Corononavirus-HKU1
TSMELF

SEQ ID NO: 242 - protein, 4 aa, Corononavirus-HKU1
LPFF

SEQ ID NO: 243 - protein, 12 aa, Corononavirus-HKU1
HFYNCRSCYRTF

SEQ ID NO: 244 - protein, 6 aa, Corononavirus-HKU1
TTCKSN

SEQ ID NO: 245 - protein, 7 aa, Corononavirus-HKU1
CFTLCSY

SEQ ID NO: 246 - protein, 10 aa, Corononavirus-HKU1
ASWLYDAFVL

SEQ ID NO: 247 - protein, 7 aa, Corononavirus-HKU1
RWTACLR

SEQ ID NO: 248 - protein, 5 aa, Corononavirus-HKU1
FICRY

SEQ ID NO: 249 - protein, 4 aa, Corononavirus-HKU1
SVTF

SEQ ID NO: 250 - protein, 8 aa, Corononavirus-HKU1
FVCSCSRE

SEQ ID NO: 251 - protein, 13 aa, Corononavirus-HKU1
FSECCCVLCTIIV

SEQ ID NO: 252 - protein, 14 aa, Corononavirus-HKU1
AYITCRQKVNYYSL

SEQ ID NO: 253 - protein, 9 aa, Corononavirus-HKU1
WYLCNPDYV

SEQ ID NO: 254 - protein, 6 aa, Corononavirus-HKU1
YFYVSF

SEQ ID NO: 255 - protein, 6 aa, Corononavirus-HKU1
HCSCFS

SEQ ID NO: 256 - protein, 17 aa, Corononavirus-HKU1
RGCAIRKGFRYFCGMCT

SEQ ID NO: 257 - protein, 4 aa, Corononavirus-HKU1
MLFH

SEQ ID NO: 258 - protein, 5 aa, Corononavirus-HKU1
NKIYY

SEQ ID NO: 259 - protein, 13 aa, Corononavirus-HKU1
IYDICSSCWFGIY

SEQ ID NO: 260 - protein, 9 aa, Corononavirus-HKU1
QFGTYIFKE

SEQ ID NO: 261 - protein, 4 aa, Corononavirus-HKU1
YCSC

SEQ ID NO: 262 - protein, 9 aa, Corononavirus-HKU1
FRCSYTEWC

SEQ ID NO: 263 - protein, 4 aa, Corononavirus-HKU1
ACTG

SEQ ID NO: 264 - protein, 7 aa, Corononavirus-HKU1
YFLYMVY

SEQ ID NO: 265 - protein, 4 aa, Corononavirus-HKU1
STYC

SEQ ID NO: 266 - protein, 6 aa, Corononavirus-HKU1
IKKSMC

SEQ ID NO: 267 - protein, 9 aa, Corononavirus-HKU1
NWLEVKIDF

SEQ ID NO: 268 - protein, 14 aa, Corononavirus-HKU1
ARGKCPYSYNTLFT

SEQ ID NO: 269 - protein, 6 aa, Corononavirus-HKU1
RRCCIE

SEQ ID NO: 270 - protein, 8 aa, Corononavirus-HKU1
FVIYIIFC

SEQ ID NO: 271 - protein, 14 aa, Corononavirus-HKU1
FNLFYIIVGFIAYI

SEQ ID NO: 272 - protein, 7 aa, Corononavirus-HKU1
YSFACLC

SEQ ID NO: 273 - protein, 4 aa, Corononavirus-HKU1
RYFS

SEQ ID NO: 274 - protein, 4 aa, Corononavirus-HKU1
FMFC

SEQ ID NO: 275 - protein, 4 aa, Corononavirus-HKU1
IFPI

SEQ ID NO: 276 - protein, 9 aa, Corononavirus-HKU1
VHFWVCLLS

SEQ ID NO: 277 - protein, 12 aa, Corononavirus-HKU1
FYGLPYCSGSYG

SEQ ID NO: 278 - protein, 7 aa, Corononavirus-HKU1
RYRFYYV

SEQ ID NO: 279 - protein, 17 aa, Corononavirus-HKU1
SFETWLSCFTFFNLCIC

SEQ ID NO: 280 - protein, 12 aa, Corononavirus-HKU1
CSVLYTTYSDFL

SEQ ID NO: 281 - protein, 11 aa, Corononavirus-HKU1
WLCFIIFVYYV

SEQ ID NO: 282 - protein, 28 aa, Corononavirus-HKU1
WYTTSLLLFRWCYEECFFVYIFGSTYTL

SEQ ID NO: 283 - protein, 6 aa, Corononavirus-HKU1
WFYKIS

SEQ ID NO: 284 - protein, 14 aa, Corononavirus-HKU1
RYCTYCKNALYDLL

SEQ ID NO: 285 - protein, 4 aa, Corononavirus-HKU1
SGCM

SEQ ID NO: 286 - protein, 8 aa, Corononavirus-HKU1
IRRRGYMF

SEQ ID NO: 287 - protein, 5 aa, Corononavirus-HKU1
FLGFE

SEQ ID NO: 288 - protein, 8 aa, Corononavirus-HKU1
KYAWNFLW

SEQ ID NO: 289 - protein, 6 aa, Corononavirus-HKU1
FVLSIF

SEQ ID NO: 290 - protein, 12 aa, Corononavirus-HKU1
FNSSYRFLFSYC

SEQ ID NO: 291 - protein, 21 aa, Corononavirus-HKU1
FYFWSYIGYSCCLGFLLFNKT

SEQ ID NO: 292 - protein, 7 aa, Corononavirus-HKU1
ACFWRLY

SEQ ID NO: 293 - protein, 11 aa, Corononavirus-HKU1
CCSYKCCCLVY

SEQ ID NO: 294 - protein, 30 aa, Corononavirus-HKU1
FSYAFCFSSLSYLCMCLCLFLFLCNIVFSF

SEQ ID NO: 295 - protein, 39 aa, Corononavirus-HKU1
CNYAFAMDCYVWCYNAFLVLCHICSYGYCKPCFMVIFIL

SEQ ID NO: 296 - protein, 4 aa, Corononavirus-HKU1
ENWC

SEQ ID NO: 297 - protein, 10 aa, Corononavirus-HKU1
RNISYYFYDY

SEQ ID NO: 298 - protein, 4 aa, Corononavirus-HKU1
RFLL

SEQ ID NO: 299 - protein, 6 aa, Corononavirus-HKU1
IKEFCF

SEQ ID NO: 300 - protein, 4 aa, Corononavirus-HKU1
CCLQ

SEQ ID NO: 301 - protein, 5 aa, Corononavirus-HKU1
IFEFV

SEQ ID NO: 302 - protein, 4 aa, Corononavirus-HKU1
VSLL

SEQ ID NO: 303 - protein, 6 aa, Corononavirus-HKU1
NGYCCL

SEQ ID NO: 304 - protein, 8 aa, Corononavirus-HKU1
RSGVFSVS

SEQ ID NO: 305 - protein, 5 aa, Corononavirus-HKU1
SYGNI

SEQ ID NO: 306 - protein, 29 aa, Corononavirus-HKU1
CLIPTSYSICFYIFFAIRYCKDGISYVKN

SEQ ID NO: 307 - protein, 4 aa, Corononavirus-HKU1
TLYC

SEQ ID NO: 308 - protein, 4 aa, Corononavirus-HKU1
CYLW

SEQ ID NO: 309 - protein, 9 aa, Corononavirus-HKU1
YDFEWFMVR

SEQ ID NO: 310 - protein, 13 aa, Corononavirus-HKU1
QSLLSSSCYMFIL

SEQ ID NO: 311 - protein, 4 aa, Corononavirus-HKU1
YERT

SEQ ID NO: 312 - protein, 6 aa, Corononavirus-HKU1
LFCLIV

SEQ ID NO: 313 - protein, 4 aa, Corononavirus-HKU1
SYSR

SEQ ID NO: 314 - protein, 39 aa, Corononavirus-HKU1
FYYNVWSDEFNSCVLPDAGLSTCFDSLFTKSLHSKIYFW

SEQ ID NO: 315 - protein, 8 aa, Corononavirus-HKU1
NFYCFSCV

SEQ ID NO: 316 - protein, 12 aa, Corononavirus-HKU1
WPTTRGISCYYA

SEQ ID NO: 317 - protein, 17 aa, Corononavirus-HKU1
RFFFVWVMWICWLCINR

SEQ ID NO: 318 - protein, 17 aa, Corononavirus-HKU1
VCIYASIRAQYWLSHWH

SEQ ID NO: 319 - protein, 5 aa, Corononavirus-HKU1
FLWSI

SEQ ID NO: 320 - protein, 9 aa, Corononavirus-HKU1
RCSSCTVAS

SEQ ID NO: 321 - protein, 6 aa, Corononavirus-HKU1
GLRPDC

SEQ ID NO: 322 - protein, 10 aa, Corononavirus-HKU1
CYCLALCSYT

SEQ ID NO: 323 - protein, 7 aa, Corononavirus-HKU1
LCLVCTK

SEQ ID NO: 324 - protein, 4 aa, Corononavirus-HKU1
CLFY

SEQ ID NO: 325 - protein, 8 aa, Corononavirus-HKU1
CLGYGKWF

SEQ ID NO: 326 - protein, 19 aa, Corononavirus-HKU1
PSKSRSCLRCFGFNDRCFY

SEQ ID NO: 327 - protein, 6 aa, Corononavirus-HKU1
NFIGCY

SEQ ID NO: 328 - protein, 17 aa, Corononavirus-HKU1
ASIYGISRSSNTRKLYF

SEQ ID NO: 329 - protein, 4 aa, Corononavirus-HKU1
IGTF

SEQ ID NO: 330 - protein, 8 aa, Corononavirus-HKU1
RLSTIGWC

SEQ ID NO: 331 - protein, 5 aa, Corononavirus-HKU1
NKKIY

SEQ ID NO: 332 - protein, 13 aa, Corononavirus-HKU1
RNNLLDFDIYIFV

SEQ ID NO: 333 - protein, 7 aa, Corononavirus-HKU1
LYNFCIC

SEQ ID NO: 334 - protein, 7 aa, Corononavirus-HKU1
MDYIYVY

SEQ ID NO: 335 - protein, 14 aa, Corononavirus-HKU1
YTYDWCYIMCTLFC

SEQ ID NO: 336 - protein, 6 aa, Corononavirus-HKU1
FYDVTS

SEQ ID NO: 337 - protein, 24 aa, Corononavirus-HKU1
AFLFDYVYNSCTLYLVLCKLFSCL

SEQ ID NO: 338 - protein, 20 aa, Corononavirus-HKU1
RFYLCLALIFCSCCEFYLCL

SEQ ID NO: 339 - protein, 17 aa, Corononavirus-HKU1
SILWLYFMCFCYFYNYA

SEQ ID NO: 340 - protein, 9 aa, Corononavirus-HKU1
HFFFDVFGW

SEQ ID NO: 341 - protein, 44 aa, Corononavirus-HKU1
NSYFNFYVVFWVEFRRGCFVIYYSLFRYLYMDHYFVISYSKNCC

SEQ ID NO: 342 - protein, 4 aa, Corononavirus-HKU1
LVVC

SEQ ID NO: 343 - protein, 10 aa, Corononavirus-HKU1
YILFYRCTLY

SEQ ID NO: 344 - protein, 27 aa, Corononavirus-HKU1
IDSLELLIYRVYFILLLGIFLSFKQCF

SEQ ID NO: 345 - protein, 6 aa, Corononavirus-HKU1
NAYGCL

SEQ ID NO: 346 - protein, 11 aa, Corononavirus-HKU1
NFCSRIALYEC

SEQ ID NO: 347 - protein, 6 aa, Corononavirus-HKU1
WLTSTS

SEQ ID NO: 348 - protein, 17 aa, Corononavirus-HKU1
GYFVKFKTAWNRWRASY

SEQ ID NO: 349 - protein, 9 aa, Corononavirus-HKU1
SLPNSIKID

SEQ ID NO: 350 - protein, 4 aa, Corononavirus-HKU1
CEMC

SEQ ID NO: 351 - protein, 14 aa, Corononavirus-HKU1
CCFVKLFTAFACCF

SEQ ID NO: 352 - protein, 5 aa, Corononavirus-HKU1
VVAVL

SEQ ID NO: 353 - protein, 11 aa, Corononavirus-HKU1
NTIYFRFECSF

SEQ ID NO: 354 - protein, 15 aa, Corononavirus-HKU1
ACSIIDCFIRQSCCS

SEQ ID NO: 355 - protein, 6 aa, Corononavirus-HKU1
VSCKYR

SEQ ID NO: 356 - protein, 4 aa, Corononavirus-HKU1
LCSR

SEQ ID NO: 357 - protein, 8 aa, Corononavirus-HKU1
YRFAGFAK

SEQ ID NO: 358 - protein, 5 aa, Corononavirus-HKU1
VCKYG

SEQ ID NO: 359 - protein, 7 aa, Corononavirus-HKU1
SRKEKFG

SEQ ID NO: 360 - protein, 11 aa, Corononavirus-HKU1
STTDKTVRKSM

SEQ ID NO: 361 - protein, 6 aa, Corononavirus-HKU1
SCSSQT

SEQ ID NO: 362 - protein, 8 aa, Corononavirus-HKU1
TYGRPSTY

SEQ ID NO: 363 - protein, 4 aa, Corononavirus-HKU1
RGSD

SEQ ID NO: 364 - protein, 10 aa, Corononavirus-HKU1
SCFRFADNAF

SEQ ID NO: 365 - protein, 8 aa, Corononavirus-HKU1
SGFKFYSG

SEQ ID NO: 366 - protein, 13 aa, Corononavirus-HKU1
RLCTFECYSSIGC

SEQ ID NO: 367 - protein, 8 aa, Corononavirus-HKU1
YFNYSNTR

SEQ ID NO: 368 - protein, 7 aa, Corononavirus-HKU1
CLCYICW

SEQ ID NO: 369 - protein, 10 aa, Corononavirus-HKU1
CMAYTDCSRC

SEQ ID NO: 370 - protein, 10 aa, Corononavirus-HKU1
LASCYHCEQV

SEQ ID NO: 371 - protein, 5 aa, Corononavirus-HKU1
CCYAE

SEQ ID NO: 372 - protein, 4 aa, Corononavirus-HKU1
VDAS

SEQ ID NO: 373 - protein, 6 aa, Corononavirus-HKU1
IKNTSC

SEQ ID NO: 374 - protein, 7 aa, Corononavirus-HKU1
YSYSMLL

SEQ ID NO: 375 - protein, 6 aa, Corononavirus-HKU1
NSLCCS

SEQ ID NO: 376 - protein, 4 aa, Corononavirus-HKU1
DNER

SEQ ID NO: 377 - protein, 8 aa, Corononavirus-HKU1
WKLCCFRA

SEQ ID NO: 378 - protein, 6 aa, Corononavirus-HKU1
IFYTRC

SEQ ID NO: 379 - protein, 5 aa, Corononavirus-HKU1
VSLFY

SEQ ID NO: 380 - protein, 11 aa, Corononavirus-HKU1
RVGCWYFIFNN

SEQ ID NO: 381 - protein, 7 aa, Corononavirus-HKU1
IAGWCCY

SEQ ID NO: 382 - protein, 13 aa, Corononavirus-HKU1
FFYTFIMCIFCRS

SEQ ID NO: 383 - protein, 15 aa, Corononavirus-HKU1
ENLFRLYTTRWCTYN

SEQ ID NO: 384 - protein, 10 aa, Corononavirus-HKU1
SCWYWYGHYY

SEQ ID NO: 385 - protein, 26 aa, Corononavirus-HKU1
PRFLWWCLSLYLLPCTCRASRCRWYM

SEQ ID NO: 386 - protein, 18 aa, Corononavirus-HKU1
ICTSPFGYKRSYSLCVNT

SEQ ID NO: 387 - protein, 24 aa, Corononavirus-HKU1
CLSSLWFLERWQLFLCRFKCRCSI

SEQ ID NO: 388 - protein, 2723 aa, Corononavirus-HKU1
RFKFFKRVRGTSVNARLVPCASGLSTDVQLRAFDICNTNRAGIGLYYKVNCCRFQRIDDDGNKLDKFFVVKRTNLEVYNKEKTYYELTKSCGVVAEHDFFTFDIDGSRVPHIVRRNLSKYTMLDLCYALRHFDRNDCSILCEILCEYADCKESYFSKKDWYDFVENPDIINIYKKLGPIFNRALLNTVIFADTLVEVGLVGVLTLDNQDLYGQWYDFGDFIQTAPGFGVAVADSYYSYMMPMLTMCHVLDCELFVNDSYRQFDLVQYDFTDYKLELFNKYFKYWGMKYHPNTVDCDNDRCIIHCANFNILFSMVLPNTCFGPLVRQIFVDGVPFVVSIGYHYKELGVVMNLDVDTHRYRLSLKDLLLYAADPAMHVASASALLDLRTCCFSVAAITSGIKFQTVKPGNFNQDFYEFVKSKGLFKEGSTVDLKHFFFTQDGNAAITDYNYYKYNLPTMVDIKQLLFVLEVVYKYFEIYDGGCIPASQVIVNNYDKSAGYPFNKFGKARLYYEALSFEEQNEIYAYTKRNVLPTLTQMNLKYAISAKNRARTVAGVSILSTMTGRMFHQKCLKSIAATRGVPVVIGTTKFYGGWDDMLRHLIKDVDNPVLMGWDYPKCDRAMPNILRIVSSLVLARKHEFCCSHGDRFYRLANECAQVLSEIVMCGGCYYVKPGGTSSGDATTAFANSVFNICQAVTANVCSLMACNGHKIEDLSIRNLQKRLYSNVYRTDYVDYTFVNEYYEFLCKHFSMMILSDDGVVCYNSDYASKGYIANISVFQQVLYYQNNVFMSESKCWVENDITNGPHEFCSQHTMLVKIDGDYVYLPYPDPSRILGAGCFVDDLLKTDSVLLIERFVSLAIDAYPLVHHENEEYQKVFRVYLEYIKKLYNDLGTQILDSYSVILSTCDGLKFTEESFYKNMYLKSAVMQSVGACVVCSSQTSLRCGSCIRKPLLCCKCCYDHVMATNHKYVLSVSPYVCNAPNCDVSDVTKLYLGGMSYYCENHKPHYSFKLVMNGMVFGLYKQSCTGSPYIDDFNKIASCKWTEVDDYVLANECIERLKLFAAETQKATEEAFKQSYASATIQEIVSDREVILCWETGKVKPPLNKNYVFTGYHFTSTGKTVLGEYVFDKSELTNGVYYRATTTYKLSIGDVFVLTSHSVASLSAPTLVPQENYASIRFSSVYSVPLVFQNNVANYQHIGMKRYCTVQGPPGTGKSHLAIGLAVYYYTARVVYTAASHAAVDALCEKAYKFLNINDCTRIIPAKVRVDCYDKFKINDTTCKYVFTTINALPELVTDIVVVDEVSMLTNYELSVINARIKAKHYVYIGDPAQLPAPRVLLSKGSLEPRHFNSITKIMCCLGPDIFLGNCYRCPKEIVETVSALVYDNKLKAKNDNSSLCFKVYFKGQTTHESSSAVNIQQIYLISKFLKANPVWNSAVFISPYNSQNYVAKRVLGVQTQTVDSAQGSEYDYVIYSQTAETAHSVNVNRFNVAITRAKKGIFCVMSNMQLFESLNFITLPLDKIQNQTLPRLHCTTNLFKDCSKSCLGYHPAHAPSFLAVDDKYKVNENLAVNLNICEPVLTYSRLISLMGFKLDLTLDGYSKLFITKDEAIKRVRGWVGFDVEGAHATRENIGTNFPLQIGFSTGVDFVVEATGLFAERDCYTFKKTVAKAPPGEKFKHLIPLMSKGQKWDIVRIRIVQMLSDYLLDLSDSVVFITWSASFELTCLRYFAKLGRELNCNVCSNRATCYNSRTGYYGCWRHSYTCDYVYNPLIVDIQQWGYTGSLTSNHDIICNVHKGAHVASADAIMTRCLAIYDCFCKSVNWNLEYPIISNEVSINTSCRLLQRVMLKAAMLCNRYNLCYDIGNPKGLACVKDYEFKFYDAFPVAKSVKQLFYVYDVHKDNFKDGLCMFWNCNVDKYPSNSIVCRFDTRVLNKLNLPGCNGGSLYVNKHAFHTNPFTRTVFENLKPMPFFYYSDTPCVYVDGLESKQVDYVPLRSATCITRCNLGGAVCSKHAEEYCNYLESYNIVTTAGFTFWVYKNFDFYNLWNTFTTLQSLENVIYNLVNVGHYDGRTGELPCAIMNDKVVVKINNVDTVIFKNNTSFPTNIAVELFTKRSIRHHPELKILRNLNIDICWKHVLWDYVKDSLFCSSTYGVCKYTDLKFIENLNILFDGRDTGALEAFRKARNGVFISTEKLSRLSMIKGPQRADLNGVIVDKVGELKVEFWFAMRKDGDDVIFSRTDSLCSSHYWSPQGNLGGNCAGNVIGNDALTRFTIFTQSRVLSSFEPRSDLERDFIDMDDNLFIAKYGLEDYAFDHIVYGSFNHKVIGGLHLLIGLFRRKKKSNLLIQEFLQYDSSIHSYFITDQECGSSKSVCTVIDLLLDDFVSIVKSLNLSCVSKVVNINVDFKDFQFMLWCNDNKIMTFYPKMQATNDWKPGYSMPVLYKYLNVPLERVSLWNYGKPINLPTGCMMNVAKYTQLCQYLNTTTLAVPVNMRVLHLGAGSDKEVAPGSAVLRQWLPSGSILVDNDLNPFVSDSLVTYFGDCMTLPFDCHWDLIISDMYDPLTKNIGDYNVSKDGFFTYICHLIRDKLSLGGSVAIKITEFSWNADLYKLMSCFAFWTVFCTNVNASSSEGFLIGINYLGKSSFEIDGNVMHANYLFWRNSTTWNGGAYSLFDMTKFSLKLAGTAVVNLRPDQLNDLVYSLIERGKLLVRDTRKEIFVGDSLVNTC

SEQ ID NO: 389 - protein, 20 aa, Corononavirus-HKU1
ISLNLNYVNYFFIFLFLLWF

SEQ ID NO: 390 - protein, 7 aa, Corononavirus-HKU1
CCVSFKP

SEQ ID NO: 391 - protein, 5 aa, Corononavirus-HKU1
LVFIW

SEQ ID NO: 392 - protein, 6 aa, Corononavirus-HKU1
LFGYSP

SEQ ID NO: 393 - protein, 5 aa, Corononavirus-HKU1
FVQQW

SEQ ID NO: 394 - protein, 8 aa, Corononavirus-HKU1
EFSFHSIL

SEQ ID NO: 395 - protein, 5 aa, Corononavirus-HKU1
LHWRR

SEQ ID NO: 396 - protein, 5 aa, Corononavirus-HKU1
SNYFL

SEQ ID NO: 397 - protein, 4 aa, Corononavirus-HKU1
CMAS

SEQ ID NO: 398 - protein, 10 aa, Corononavirus-HKU1
QGKILSCLIF

SEQ ID NO: 399 - protein, 10 aa, Corononavirus-HKU1
YGLFSLSYFC

SEQ ID NO: 400 - protein, 4 aa, Corononavirus-HKU1
CFSF

SEQ ID NO: 401 - protein, 4 aa, Corononavirus-HKU1
YFIT

SEQ ID NO: 402 - protein, 5 aa, Corononavirus-HKU1
QSYFY

SEQ ID NO: 403 - protein, 19 aa, Corononavirus-HKU1
GSLFYFIRLFSLFSTALPF

SEQ ID NO: 404 - protein, 4 aa, Corononavirus-HKU1
SVLL

SEQ ID NO: 405 - protein, 10 aa, Corononavirus-HKU1
HRYWLCLWFF

SEQ ID NO: 406 - protein, 4 aa, Corononavirus-HKU1
CCLS

SEQ ID NO: 407 - protein, 8 aa, Corononavirus-HKU1
FRLYLYFS

SEQ ID NO: 408 - protein, 4 aa, Corononavirus-HKU1
TRFL

SEQ ID NO: 409 - protein, 12 aa, Corononavirus-HKU1
SFHHCTFFILTY

SEQ ID NO: 410 - protein, 4 aa, Corononavirus-HKU1
SSLF

SEQ ID NO: 411 - protein, 8 aa, Corononavirus-HKU1
TICTCTGC

SEQ ID NO: 412 - protein, 27 aa, Corononavirus-HKU1
MEQRACLRYFFICCMSIAILLFSQFFC

SEQ ID NO: 413 - protein, 5 aa, Corononavirus-HKU1
LCWQV

SEQ ID NO: 414 - protein, 11 aa, Corononavirus-HKU1
WFYFYFIWSFI

SEQ ID NO: 415 - protein, 12 aa, Corononavirus-HKU1
CFLYFILWCIFI

SEQ ID NO: 416 - protein, 11 aa, Corononavirus-HKU1
FYIHLALLFFW

SEQ ID NO: 417 - protein, 7 aa, Corononavirus-HKU1
VSYIFYY

SEQ ID NO: 418 - protein, 6 aa, Corononavirus-HKU1
TSNLCL

SEQ ID NO: 419 - protein, 26 aa, Corononavirus-HKU1
FFAYYFTRYFIMFSFTFCCFSIIFVI

SEQ ID NO: 420 - protein, 1362 aa, Corononavirus-HKU1
ISLNLNMLLIIFILPTTLAVIGDFNCTNFAINDLNTTVPRISEYVVDVSYGLGTYYILDRVYLNTTILFTGYFPKSGANFRDLSLKGTTYLSTLWYQKPFLSDFNNGIFSRVKNTKLYVNKTLYSEFSTIVIGSVFINNSYTIVVQPHNGVLEITACQYTMCEYPHTICKSKGSSRNESWHFDKSEPLCLFKKNFTYNVSTDWLYFHFYQERGTFYAYYADSGMPTTFLFSLYLGTLLSHYYVLPLTCNAISSNTDNETLQYWVTPLSKRQYLLKFDNRGVITNAVDCSSSFFSEIQCKTKSLLPNTGVYDLSGFTVKPVATVHRRIPDLPDCDIDKWLNNFNVPSPLNWERKIFSNCNFNLSTLLRLVHTDSFSCNNFDESKIYGSCFKSIVLDKFAIPNSRRSDLQLGSSGFLQSSNYKIDTTSSSCQLYYSLPAINVTINNYNPSSWNRRYGFNNFNLSSHSVVYSRYCFSVNNTFCPCAKPSFASSCKSHKPPSASCPIGTNYRSCESTTVLDHTDWCRCSCLPDPITAYDPRSCSQKKSLVGVGEHCAGFGVDEEKCGVLDGSYNVSCLCSTDAFLGWSYDTCVSNNRCNIFSNFILNGINSGTTCSNDLLQPNTEVFTDVCVDYDLYGITGQGIFKEVSAVYYNSWQNLLYDSNGNIIGFKDFVTNKTYNIFPCYAGRVSAAFHQNASSLALLYRNLKCSYVLNNISLTTQPYFDSYLGCVFNADNLTDYSVSSCALRMGSGFCVDYNSPSSSSSRRKRRSISASYRFVTFEPFNVSFVNDSIESVGGLYEIKIPTNFTIVGQEEFIQTNSPKVTIDCSLFVCSNYAACHDLLSEYGTFCDNINSILDEVNGLLDTTQLHVADTLMQGVTLSSNLNTNLHFDVDNINFKSLVGCLGPHCGSSSRSFFEDLLFDKVKLSDVGFVEAYNNCTGGSEIRDLLCVQSFNGIKVLPPILSESQISGYTTAATVAAMFPPWSAAAGIPFSLNVQYRINGLGVTMDVLNKNQKLIATAFNNALLSIQNGFSATNSALAKIQSVVNSNAQALNSLLQQLFNKFGAISSSLQEILSRLDALEAQVQIDRLINGRLTALNAYVSQQLSDISLVKFGAALAMEKVNECVKSQSPRINFCGNGNHILSLVQNAPYGLLFMHFSYKPISFKTVLVSPGLCISGDVGIAPKQGYFIKHNDHWMFTGSSYYYPEPISDKNVVFMNTCSVNFTKAPLVYLNHSVPKLSDFESELSHWFKNQTSIAPNLTLNLHTINATFLDLYYEMNLIQESIKSLNNSYINLKDIGTYEMYVKWPWYVWLLISFSFIIFLVLLFFICCCTGCGSACFSKCHNCCDEYGGHHDFVIKTSHDD

SEQ ID NO: 421 - protein, 39 aa, Corononavirus-HKU1
NLLSDLIKSKLYLWTFGDLATHILLLLENLVLQTLKICV

SEQ ID NO: 422 - protein, 15 aa, Corononavirus-HKU1
SIITVNLLLVTVLYL

SEQ ID NO: 423 - protein, 29 aa, Corononavirus-HKU1
MFGVASLANLLLTLHYVVTIFPIVIILVL

SEQ ID NO: 424 - protein, 16 aa, Corononavirus-HKU1
LVLLLMVILFLRLCLD

SEQ ID NO: 425 - protein, 99 aa, Corononavirus-HKU1
LNQLLNLLFGVQRHLISMVDLFFNDTAWYIGQILVLVLFCLISLIFVVAFLATIKLCMQLCGFCNFFIISPSAYVYKRGMQLYKSYSEQVIPPTSDYLI

SEQ ID NO: 426 - protein, 16 aa, Corononavirus-HKU1
INLFFLNLLLIKLLHS

SEQ ID NO: 427 - protein, 8 aa, Corononavirus-HKU1
KNGISLWV

SEQ ID NO: 428 - protein, 24 aa, Corononavirus-HKU1
YYFLLLSYCSSVIRAVVCLFILSR

SEQ ID NO: 429 - protein, 8 aa, Corononavirus-HKU1
LFFGLCGH

SEQ ID NO: 430 - protein, 8 aa, Corononavirus-HKU1
LYLIVFML

SEQ ID NO: 431 - protein, 8 aa, Corononavirus-HKU1
IMLFLHFL

SEQ ID NO: 432 - protein, 41 aa, Corononavirus-HKU1
CLLLFLLLYGFFILLIVFGFLLELAVGGVLIQRPIILCVLI

SEQ ID NO: 433 - protein, 15 aa, Corononavirus-HKU1
KARCLLGQLLRTITH

SEQ ID NO: 434 - protein, 30 aa, Corononavirus-HKU1
LLLLFVVIFIYRVSNLALVILFQICPYMLL

SEQ ID NO: 435 - protein, 13 aa, Corononavirus-HKU1
LRCKYFVPINVPF

SEQ ID NO: 436 - protein, 31 aa, Corononavirus-HKU1
MLIVVLLFLLSLKLVTIVYRLVNLVVWILPC

SEQ ID NO: 437 - protein, 220 aa, Corononavirus-HKU1
ELKSKLLGCLILPVIMLEVEAPLEIVQESSRKLLGLTNLSEITKPLIEAEKPNLNSLCLLNHKEILSHIIPGSPGSLNFKKVETLNFQMVKEFPLLSEYPLLKQKDIGIDTAGVLLKQLMVNKSSCYRDGISTISVPAHMPMHPMVNPSKGSSGLLITKLTLLLPPMFRQGILLLKKLSLLGFRLVRFCLKAIMLKAQEGLLLIVDQVHVLNHVDPIIVH

SEQ ID NO: 438 - protein, 12 aa, Corononavirus-HKU1
VEVILILDIQIL

SEQ ID NO: 439 - protein, 12 aa, Corononavirus-HKU1
NLIWLMRSLILF

SEQ ID NO: 440 - protein, 24 aa, Corononavirus-HKU1
PSLVKILNLSKSLSKMPRKSGIKF

SEQ ID NO: 441 - protein, 33 aa, Corononavirus-HKU1
QNLAKSELLINIVMFNSVLVKEDLLKILVMLKC

SEQ ID NO: 442 - protein, 14 aa, Corononavirus-HKU1
SLVLMILSFLFLQN

SEQ ID NO: 443 - protein, 12 aa, Corononavirus-HKU1
LLHQVLFSLVLN

SEQ ID NO: 444 - protein, 37 aa, Corononavirus-HKU1
TWLKEIPRLTHLLKMFLNFIILVLLGLIVLYQALRQL

SEQ ID NO: 445 - protein, 6 aa, Corononavirus-HKU1
KFLKRI

SEQ ID NO: 446 - protein, 14 aa, Corononavirus-HKU1
MLTLILIRTLILIR

SEQ ID NO: 447 - protein, 21 aa, Corononavirus-HKU1
VLNLSVKEVLNNYQNSLTLLI

SEQ ID NO: 448 - protein, 26 aa, Corononavirus-HKU1
VLVLSTFQMILLLRIIVYLLLLMILM

SEQ ID NO: 449 - protein, 10 aa, Corononavirus-HKU1
KTLLLNENES

SEQ ID NO: 450 - protein, 5 aa, Corononavirus-HKU1
FDTRW

SEQ ID NO: 451 - protein, 21 aa, Corononavirus-HKU1
PLAIIRNRTLSIRMNSCCNNR

SEQ ID NO: 452 - protein, 8 aa, Corononavirus-HKU1
SRLLQTIY

SEQ ID NO: 453 - protein, 9 aa, Corononavirus-HKU1
LVEILYLDI

SEQ ID NO: 454 - protein, 5 aa, Corononavirus-HKU1
GLAVV

SEQ ID NO: 455 - protein, 11 aa, Corononavirus-HKU1
TPPGRAINCSV

SEQ ID NO: 456 - protein, 18 aa, Corononavirus-HKU1
YMIEINYSLLEELQKKKK

SEQ ID NO: 457 - DNA, 29942 bp, Corononavirus-HKU1; identical to SEQ ID NO: 3
  CDS (2)..(29941)

SEQ ID NO: 458 - protein, 38 aa, Corononavirus-HKU1
NKSELRPYRLSAYDLLSDLIKSKLFKQDSLLSMLVSVV

SEQ ID NO: 459 - protein, 24 aa, Corononavirus-HKU1
SCILLSTLFISLPVTCWLSSASLP

SEQ ID NO: 460 - protein, 4473 aa, Corononavirus-HKU1
VAMIKTSKYGLGFKWAPEFRWLLPDAAEELASPMKSDEGGLCPSTGQAMESVGFVYDNHVKIDCRCILGQEWHVQSNLIRDIFVHEDLHVVEVLTKTAVKSGTAILIKSPLHSLGGFPKGYVMGLFRSYKTKRYVVHHLSMTTSTTNFGEDFLGWIVPFGFMPSYVHKWFQFCRLYIEESDLIISNFKFDDYDFSVEDAYAEVHAEPKGKYSQKAYALLRQYRGIKPVLFVDQYGCDYSGKLADCLQAYGHYSLQDMRQKQSVWLANCDFDIVVAWHVVRDSRFVMRLQTIATICGIKYVAQPTEDVVDGDVVIREPVHLLSADAIVLKLPSLMKVMTHMDDFSIKSIYNVDLCDCGFVMQYGYVDCFNDNCDFYGWVSGNMMDGFSCPLCCTVYDSSEVKAQSSGVIPENPVLFTNSTDTVNHDSFNLYGYSVTPFGSCIYWSPRPGLWIPIIKSSVKSYDDLVYSGVVGCKSIVKETALITHALYLDYVQCKCGNLEQNHILGVNNSWCRQLLLNRGDYNMLLKNIDLFVKRRADFACKFAVCGDGFVPFLLDGLIPRSYYLIQSGIFFTSLMSQFSQEVSDMCLKMCILFMDRVSVATFYIEHYVNRLVTQFKLLGTTLVNKMVNWFNTMLDASAPATGWLLYQLLNGLFVVSQANFNFVALIPDYAKILVNKFYTFFKLLLECVTVDVLKDMPVLKTINGLVCIVGNKFYNVSTGLIPGFVLPCNAQEQQIYFFEGVAESVIVEDDVIENVKSSLSSYEYCQPPKSVEKICIIDNMYMGKCGDKFFPIVMNDKNICLLDQAWRFPCAGRKVNFNEKPVVMEIPSLMTVKVMFDLDSTFDDILGKVCSEFEVEKGVTVDDFVAVVCDAIENALNSCKEHPVVGYQVRAFLNKLNENVVYLFDEAGDEAMASRMYCTFAIEDVEDVISSEAVEDTIDGVVEDTINDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNNDEEIVTGDNDDQIVVTGDDVDDIESIYDFDTYKALLVFNDVYNDALFVSYGSSVETETYFKVNGLWSPTITHTNCWLRSVLLVMQKLPFKFKDLAIENMWLSYKVGYNQSFVDYLLTTIPKAIVLPQGGFVADFAYWFLNQFDINAYANWCCLKCGFSFDLNGLDALFFYGDIVSHVCKCGHNMTLIAADLPCTLHFSLFDDNFCAFCTPKKIFIAACAVDVNVCHSVAVIGDEQIDGKFVTKFSGDKFDFIVGYGMSFSMSSFELPQLYGLCITPNVCFVKGDIINVARLVKADVIVNPANGHMLHGGGVAKAIAVAAGKKFSKETAAMVKSKGVCQVGDCYVSTGGKLCKTILNIVGPDARQDGRQSYVLLARAYKHLNNYDCCLSTLISAGIFSVPADVSLTYLLGVVDKQVILVSNNKEDFDIIQKCQITSVVGTKALAVRLTANVGRVIKFETDAYKLFLSGDDCFVSNSSVIQEVLLLRHDIQLNNDVRDYLLSKMTSLPKDWRLINKFDVINGVKTVKYFECPNSIYICSQGKDFGYVCDGSFYKATVNQVCVLLAKKIDVLLTVDGVNFKSISLTVGEVFGKILGNVFCDGIDVTKLKCSDFYADKILYQYENLSLADISAVQSSFGFDQQQLLAYYNFLTVCKWSVVVNGPFFSFEQSHNNCYVNVACLMLQHINLKFNKWQWQEAWYEFRAGRPHRLVALVLAKGHFKFDEPSDATDFIRVVLKQADLSGAICELELICDCGIKQESRVGVDAVMHFGTLAKTDLFNGYKIGCNCAGRIVHCTKLNVPFLICSNTPLSKDLPDDVVAANMFMGVGVGHYTHLKCGSPYQHYDACSVKKYTGVSGCLTDCLYLKNLTQTFTSMLTNYFLDDVEMVAYNPDLSQYYCDNGKYYTKPIIKAQFKPFAKVDGVYTNFKLVGHDICAQLNDKLGFNVDLPFVEYKVTVWPVATGDVVLASDDLYVKRYFKGCETFGKPVIWFCHDEASLNSLTYFNKPSFKSENRYSVLSVDSVSEESQGNVVTSVMESQISTKEVKLKGVRKTVKIEDAIIVNDENSSIKVVKSLSLVDVWDMYLTGCDYVVWVANELSRLVKSPTVREYIRYGIKPITIPIDLLCLRDDNQTLLVPKIFKARAIEFYGFLKWLFIYVFSLLHFTNDKTIFYTTEIASKFTFNLFCLALKNAFQTFRWSIFIKGFLVVATVFLFWFNFLYINVIFSDFYLPNISVFPIFVGRIVMWIKATFGLVTICDFYSKLGVGFTSHFCNGSFICELCHSGFDMLDTYAAIDFVQYEVDRRVLFDYVSLVKLIVELVIGYSLYTVWFYPLFCLIGLQLFTTWLPDLFMLETMHWLIRFIVFVANMLPAFVLLRFYIVVTAMYKVVGFIRHIVYGCNKAGCLFCYKRNCSVRVKCSTIVGGVIRYYDITANGGTGFCVKHQWNCFNCHSFKPGNTFITVEAAIELSKELKRPVNPTDASHYVVTDIKQVGCMMRLFYDRDGQRVYDDVDASLFVDINNLLHSKVKVVPNLYVVVVESDADRANFLNAVVFYAQSLYRPILLVDKKLITTACNGISVTQTMFDVYVDTFMSHFDVDRKSFNNFVNIAHASLREGVQLEKVLDTFVGCVRKCCSIDSDVETRFITKSMISAVAAGLEFTDENYNNLVPTYLKSDNIVAADLGVLIQNGAKHVQGNVAKAANISCIWFIDAFNQLTADLQHKLKKACVKTGLKLKLTFNKQEASVPILTTPFSLKGGVVLSNLLYILFFVSLICFILLWALLPTYSVYKSDIHLPAYASFKVIDNGVVRDISVNDLCFANKFFQFDQWYESTFGSVYYHNSMDCPIVVAVMDEDIGSTMFNVPTKVLRHGFHVLHFLTYAFASDSVQCYTPHIQISYNDFYASGCVLSSLCTMFKRGDGTPHPYCYSDGVMKNASLYTSLVPHTRYSLANSNGFIRFPDVISEGIVRIVRTRSMTYCRVGACEYAEEGICFNFNSSWVLNNDYYRSMPGTFCGRDLFDLFYQFFSSLIRPIDFFSLTASSIFGAILAIVVVLVFYYLIKLKRAFGDYTSVVVINVVVWCINFLMLFVFQVYPICACVYACFYFYVTLYFPSEISVIMHLQWIVMYGAIMPFWFCVTYVAMVIANHVLWLFSYCRKIGVNVCSDSTFEETSLTTFMITKDSYCRLKNSVSDVAYNRYLSLYNKYRYYSGKMDTAAYREAACSQLAKAMETFNHNNGNDVLYQPPTASVSTSFLQSGIVKMVSPTSKIEPCIVSVTYGSMTLNGLWLDDKVYCPRHVICSSSNMNEPDYSALLCRVTLGDFTIMSGRMSLTVVSYQMQGCQLVLTVSLQNPYTPKYTFGNVKPGETFTVLAAYNGRPQGAFHVTMRSSYTIKGSFLCGSCGSVGYVLTGDSVKFVYMHQLELSTGCHTGTDFTGNFYGPYRDAQVVQLPVKDYVQTVNVIAWLYAAILNNCAWFVQNDVCSTEDFNVWAMANGFSQVKADLVLDALASMTGVSIETLLAAIKRLYMGFQGRQILGSCTFEDELAPSDVYQQLAGVKLQSKTKRFIKETIYWILISTFLFSCIISAFVKWTIFMYINTHMIGVTLCVLCFVSFMMLLVKHKHFYLTMYIIPVLCTLFYVNYLVVYKEGFRGFTYVWLSYFVPAVNFTYVYEVFYGCILCVFAIFITMHSINHDIFSLMFLVGRIVTLISMWYFGSNLEEDVLLFITAFLGTYTWTTILSLAIAKIVANWLSVNIFYFTDVPYIKLILLSYLFIGYILSCYWGFFSLLNSVFRMPMGVYNYKISVQELRYMNANGLRPPRNSFEAILLNLKLLGIGGVPVIEVSQIQSKLTDVKCANVVLLNCLQHLHVASNSKLWQYCSVLHNEILSTSDLSVAFDKLAQLLIVLFANPAAVDTKCLASIDEVSDDYVQDSTVLQALQSEFVNMASFVEYEVAKKNLADAKNSGSVNQQQIKQLEKACNIAKSVYERDKAVARKLERMADLALTNMYKEARINDKKSKVVSALQTMLFSMVRKLDNQALNSILDNAVKGCVPLSAIPALAANTLTIVIPDKQVFDKVVDNVYVTYAGSVWHIQTVQDADGINKQLTDISVDSNWPLVIIANRYNEVANAVMQNNELMPHKLKIQVVNSGSDMNCNIPTQCYYNNGSSGRIVYAVLSDVDGLKYTKIMKDDGNCVVLELDPPCKFSIQDVKGLKIKYLYFIKGCNTLARGWVVGTLSSTIRLQAGVATEYAANSSILSLCAFSVDPKKTYLDYIQQGGVPIINCVKMLCDHAGTGMAITIKPEATINQDSYGGASVCIYCRARVEHPDVDGICKLRGKFVQVPLGIKDPILYVLTHDVCQVCGFWRDGSCSCVGSSVAVQSKDLNFLNGFGVLV

SEQ ID NO: 461 - protein, 12 aa, Corononavirus-HKU1
YPVLVVYLLMFN

SEQ ID NO: 462 - protein, 12 aa, Corononavirus-HKU1
GHLTFVIPIELV

SEQ ID NO: 463 - protein, 5 aa, Corononavirus-HKU1
VYIIK

SEQ ID NO: 464 - protein, 7 aa, Corononavirus-HKU1
IVAVFSV

SEQ ID NO: 465 - protein, 17 aa, Corononavirus-HKU1
MTTVINWISSLLSKELI

SEQ ID NO: 466 - protein, 11 aa, Corononavirus-HKU1
KFIIKRKLIMS

SEQ ID NO: 467 - protein, 24 aa, Corononavirus-HKU1
LKVVVLWLNMISLHLILMVVACHI

SEQ ID NO: 468 - protein, 10 aa, Corononavirus-HKU1
FVGIFQSILC

SEQ ID NO: 469 - protein, 52 aa, Corononavirus-HKU1
IFAMHCVILIVMIVQYCVKFFVSMLIVKNPTFLRKIGMILLKILILLIYIKN

SEQ ID NO: 470 - protein, 17 aa, Corononavirus-HKU1
ALFLIELYLILSFLQTP

SEQ ID NO: 471 - protein, 33 aa, Corononavirus-HKU1
ITKICMVNGMILVILYKQPQGLVWQLQILTILI

SEQ ID NO: 472 - protein, 5 aa, Corononavirus-HKU1
LCVMY

SEQ ID NO: 473 - protein, 24 aa, Corononavirus-HKU1
IVNYLLMIVIDNSILYSMILLITS

SEQ ID NO: 474 - protein, 11 aa, Corononavirus-HKU1
SCLISILSIGV

SEQ ID NO: 475 - protein, 42 aa, Corononavirus-HKU1
SIILILWIVIMIGVLFIVLILIYYLVWFYLILVLVPLLDKFL

SEQ ID NO: 476 - protein, 15 aa, Corononavirus-HKU1
MVYRLLFLLVTITKS

SEQ ID NO: 477 - protein, 40 aa, Corononavirus-HKU1
MLTHTVIVCLLKIYFFMQQILLCTLHLLVLCLIYELVVLV

SEQ ID NO: 478 - protein, 6 aa, Corononavirus-HKU1
LPLQVV

SEQ ID NO: 479 - protein, 4 aa, Corononavirus-HKU1
NFKL

SEQ ID NO: 480 - protein, 26 aa, Corononavirus-HKU1
NQVTLTKTFTSLLKVKACLKRVVQLI

SEQ ID NO: 481 - protein, 35 aa, Corononavirus-HKU1
NIFSLLKMVMLQLLIIIIISIIYLLWLILSSYCLY

SEQ ID NO: 482 - protein, 65 aa, Corononavirus-HKU1
KLFINILKFMMVVVYQHHKLLLIIMIKVLVIHLINLVKPDFIMRHYHLRNRMKFMHILNVMFCPP

SEQ ID NO: 483 - protein, 12 aa, Corononavirus-HKU1
NMLSVLRIELAL

SEQ ID NO: 484 - protein, 8 aa, Corononavirus-HKU1
QVFLFLVL

SEQ ID NO: 485 - protein, 9 aa, Corononavirus-HKU1
QAECSIKNV

SEQ ID NO: 486 - protein, 9 aa, Corononavirus-HKU1
QLPEVFLLL

SEQ ID NO: 487 - protein, 16 aa, Corononavirus-HKU1
EPLNFMVVGTICYVIL

SEQ ID NO: 488 - protein, 29 aa, Corononavirus-HKU1
RMLTTLFLWVGIILNVIVLCQIFCVLLVV

SEQ ID NO: 489 - protein, 26 aa, Corononavirus-HKU1
FWPANMNFVVHMVIDFIALRMNVLKF

SEQ ID NO: 490 - protein, 51 aa, Corononavirus-HKU1
LCVAVAIMLSLVVLAVVMQLLLLLILFLIYVRLLLLMFVLLWPVMAIRLKI

SEQ ID NO: 491 - protein, 36 aa, Corononavirus-HKU1
VYAIYKNAYTLMFIVQIMLIIHLLMSIMNFYVSILV

SEQ ID NO: 492 - protein, 17 aa, Corononavirus-HKU1
VMMVLSVITLIMLVRVI

SEQ ID NO: 493 - protein, 39 aa, Corononavirus-HKU1
VFFNKFCTIRIMSLCLNLNVGLKMILLMVLMNFVPNILC

SEQ ID NO: 494 - protein, 15 aa, Corononavirus-HKU1
MVIMFIYHIQILLEF

SEQ ID NO: 495 - protein, 9 aa, Corononavirus-HKU1
ELVVLLMIY

SEQ ID NO: 496 - protein, 6 aa, Corononavirus-HKU1
RLTVFF

SEQ ID NO: 497 - protein, 4 aa, Corononavirus-HKU1
MLTL

SEQ ID NO: 498 - protein, 15 aa, Corononavirus-HKU1
YIMKMKNTKKSFVYI

SEQ ID NO: 499 - protein, 11 aa, Corononavirus-HKU1
KNCIMILVLRS

SEQ ID NO: 500 - protein, 6 aa, Corononavirus-HKU1
IVIVLF

SEQ ID NO: 501 - protein, 5 aa, Corononavirus-HKU1
VLVMV

SEQ ID NO: 502 - protein, 12 aa, Corononavirus-HKU1
SLLKNHFTRICI

SEQ ID NO: 503 - protein, 40 aa, Corononavirus-HKU1
VHALFVHHKLLCVVAVVYVSLCYVVNVVMTMLWQLIINMF

SEQ ID NO: 504 - protein, 13 aa, Corononavirus-HKU1
VSHLTFVMHLTVM

SEQ ID NO: 505 - protein, 25 aa, Corononavirus-HKU1
VMSPNYIWAVCLTIVKTINPIIHLS

SEQ ID NO: 506 - protein, 17 aa, Corononavirus-HKU1
MVWSLVCINNLARVHLI

SEQ ID NO: 507 - protein, 5 aa, Corononavirus-HKU1
MILIR

SEQ ID NO: 508 - protein, 20 aa, Corononavirus-HKU1
LVVNGQKLMIMFWQMSVLNV

SEQ ID NO: 509 - protein, 64 aa, Corononavirus-HKU1
SYLLQKLKRQLKRLLNKAMLLLPFKRLLVIEKLFCVGRQVKLNHHLIKIMFSQATILLVLVRQF

SEQ ID NO: 510 - protein, 9 aa, Corononavirus-HKU1
VSMFLIKVN

SEQ ID NO: 511 - protein, 15 aa, Corononavirus-HKU1
LTVCITALQLLINFL

SEQ ID NO: 512 - protein, 5 aa, Corononavirus-HKU1
VMFLF

SEQ ID NO: 513 - protein, 4 aa, Corononavirus-HKU1
HHIL

SEQ ID NO: 514 - protein, 13 aa, Corononavirus-HKU1
VHLHLSHKRTMLV

SEQ ID NO: 515 - protein, 23 aa, Corononavirus-HKU1
DFLVFIVFHWCFKIMLLIISTLE

SEQ ID NO: 516 - protein, 18 aa, Corononavirus-HKU1
NVIALFKVPLVRESLILL

SEQ ID NO: 517 - protein, 8 aa, Corononavirus-HKU1
LFITTQHV

SEQ ID NO: 518 - protein, 9 aa, Corononavirus-HKU1
FILLLVMLL

SEQ ID NO: 519 - protein, 10 aa, Corononavirus-HKU1
MHCVKKLISF

SEQ ID NO: 520 - protein, 14 aa, Corononavirus-HKU1
ILTIVHVLFLLKFV

SEQ ID NO: 521 - protein, 19 aa, Corononavirus-HKU1
IVMISLKLMIPLVSMFLPQ

SEQ ID NO: 522 - protein, 26 aa, Corononavirus-HKU1
MHYQSWLQILLLLMKLVCLLIMNCLL

SEQ ID NO: 523 - protein, 24 aa, Corononavirus-HKU1
MLVLKLNIMYILEILLNYLHHVCC

SEQ ID NO: 524 - protein, 4 aa, Corononavirus-HKU1
ARVL

SEQ ID NO: 525 - protein, 10 aa, Corononavirus-HKU1
NLGTSILLLK

SEQ ID NO: 526 - protein, 16 aa, Corononavirus-HKU1
VLISFWEIVIGVLKKL

SEQ ID NO: 527 - protein, 38 aa, Corononavirus-HKU1
KLFQHWFMIINSRLKMIIVHYVLKYILRDRQHMRVQVL

SEQ ID NO: 528 - protein, 6 aa, Corononavirus-HKU1
IFNRYI

SEQ ID NO: 529 - protein, 4 aa, Corononavirus-HKU1
LVNF

SEQ ID NO: 530 - protein, 25 aa, Corononavirus-HKU1
KLIQFGIVLFLLVLIIVRIMLLSVF

SEQ ID NO: 531 - protein, 6 aa, Corononavirus-HKU1
VFKHKL

SEQ ID NO: 532 - protein, 31 aa, Corononavirus-HKU1
ILLKVRNMIMLYIHKQQKQPILLMLIDLMLP

SEQ ID NO: 533 - protein, 10 aa, Corononavirus-HKU1
LEPRRAFFVL

SEQ ID NO: 534 - protein, 15 aa, Corononavirus-HKU1
VICNYLNLLILLLYL

SEQ ID NO: 535 - protein, 25 aa, Corononavirus-HKU1
IKFKIKLYLVCIAQLIFLKIVVKVA

SEQ ID NO: 536 - protein, 10 aa, Corononavirus-HKU1
VIIQRMPPHF

SEQ ID NO: 537 - protein, 13 aa, Corononavirus-HKU1
QLMINIRLMKIWL

SEQ ID NO: 538 - protein, 6 aa, Corononavirus-HKU1
IFVNLF

SEQ ID NO: 539 - protein, 4 aa, Corononavirus-HKU1
HILV

SEQ ID NO: 540 - protein, 7 aa, Corononavirus-HKU1
YLLWVLN

SEQ ID NO: 541 - protein, 44 aa, Corononavirus-HKU1
LLMVILNCLLLKMKPLNVLEVGLVLMLRALMLLAKTLEQTFHCK

SEQ ID NO: 542 - protein, 8 aa, Corononavirus-HKU1
VFQLVWIL

SEQ ID NO: 543 - protein, 18 aa, Corononavirus-HKU1
LKLLAYLLREIVILLKKL

SEQ ID NO: 544 - protein, 11 aa, Corononavirus-HKU1
LKLLLVKNLNI

SEQ ID NO: 545 - protein, 25 aa, Corononavirus-HKU1
YPLCQKVKSGILLELELFKCYLIIF

SEQ ID NO: 546 - protein, 5 aa, Corononavirus-HKU1
TFLIV

SEQ ID NO: 547 - protein, 13 aa, Corononavirus-HKU1
YLLLGLPVLNLLV

SEQ ID NO: 548 - protein, 5 aa, Corononavirus-HKU1
GILLN

SEQ ID NO: 549 - protein, 40 aa, Corononavirus-HKU1
AESLIVMCVLIVLHATILELVIMVVGAIVILVIMCIIHLL

SEQ ID NO: 550 - protein, 10 aa, Corononavirus-HKU1
IYNSGVIQVL

SEQ ID NO: 551 - protein, 5 aa, Corononavirus-HKU1
LVITI

SEQ ID NO: 552 - protein, 16 aa, Corononavirus-HKU1
FVMYIKVHMLRQLMQL

SEQ ID NO: 553 - protein, 13 aa, Corononavirus-HKU1
QSMIVFVNLLIGI

SEQ ID NO: 554 - protein, 6 aa, Corononavirus-HKU1
FLMRSV

SEQ ID NO: 555 - protein, 26 aa, Corononavirus-HKU1
IHLVGYCSVSCLKLPCYVIDTTYVMT

SEQ ID NO: 556 - protein, 5 aa, Corononavirus-HKU1
AILKV

SEQ ID NO: 557 - protein, 15 aa, Corononavirus-HKU1
LVSKIMNLNFMMLFL

SEQ ID NO: 558 - protein, 46 aa, Corononavirus-HKU1
PSLLNSYFMSMMCIKIILKMVYVCFGIVMLINIHLIQLFVDLTLEC

SEQ ID NO: 559 - protein, 45 aa, Corononavirus-HKU1
TFLDVMVVVCMLINMHSILILLLELFLKILSLCLFSIIQIRLVCT

SEQ ID NO: 560 - protein, 9 aa, Corononavirus-HKU1
NLNKLITFL

SEQ ID NO: 561 - protein, 10 aa, Corononavirus-HKU1
EAPLVSHGVI

SEQ ID NO: 562 - protein, 20 aa, Corononavirus-HKU1
VELFVQSMLKNIVTTLSLII

SEQ ID NO: 563 - protein, 28 aa, Corononavirus-HKU1
LLQQALLFGFIRILIFIIYGTLLLRYRV

SEQ ID NO: 564 - protein, 21 aa, Corononavirus-HKU1
YITWLMLVIMMDVQVNYLVLL

SEQ ID NO: 565 - protein, 10 aa, Corononavirus-HKU1
MTKLLLRLIM

SEQ ID NO: 566 - protein, 14 aa, Corononavirus-HKU1
ILLFLKIIHHFLLI

SEQ ID NO: 567 - protein, 21 aa, Corononavirus-HKU1
LLNCLQNVVSGTTLNLRFLEI

SEQ ID NO: 568 - protein, 31 aa, Corononavirus-HKU1
TLIFVGSMSCGIMLKIVCFVVPLMVFVNTQI

SEQ ID NO: 569 - protein, 5 aa, Corononavirus-HKU1
SSSKI

SEQ ID NO: 570 - protein, 11 aa, Corononavirus-HKU1
IYFLMVVTLAL

SEQ ID NO: 571 - protein, 16 aa, Corononavirus-HKU1
KLLEKQEMVFLLVLKN

SEQ ID NO: 572 - protein, 4 aa, Corononavirus-HKU1
VGYQ

SEQ ID NO: 573 - protein, 8 aa, Corononavirus-HKU1
LKVRNELI

SEQ ID NO: 574 - protein, 15 aa, Corononavirus-HKU1
LWIKLENSKLSFGSL

SEQ ID NO: 575 - protein, 26 aa, Corononavirus-HKU1
EKMVTMLSSAEQTAYAQAITGAHKVI

SEQ ID NO: 576 - protein, 13 aa, Corononavirus-HKU1
VVIARVMSLVMML

SEQ ID NO: 577 - protein, 20 aa, Corononavirus-HKU1
HVLLSLLRVVYCQVLNLAQI

SEQ ID NO: 578 - protein, 17 aa, Corononavirus-HKU1
NGILLIWMIICLLLNMV

SEQ ID NO: 579 - protein, 7 aa, Corononavirus-HKU1
KTMHLII

SEQ ID NO: 580 - protein, 9 aa, Corononavirus-HKU1
FMVVLTIKL

SEQ ID NO: 581 - protein, 6 aa, Corononavirus-HKU1
EVCICL

SEQ ID NO: 582 - protein, 11 aa, Corononavirus-HKU1
AYFVGKKNLIC

SEQ ID NO: 583 - protein, 34 aa, Corononavirus-HKU1
FKSFYSMILVFIHILLLIRSVVVVRVFVQLLIYY

SEQ ID NO: 584 - protein, 9 aa, Corononavirus-HKU1
MILFLLLSH

SEQ ID NO: 585 - protein, 27 aa, Corononavirus-HKU1
VVLVKLLILMLILRIFNLCCGVMIIKL

SEQ ID NO: 586 - protein, 24 aa, Corononavirus-HKU1
LFILKCKPLMIGNLAILCLFCISI

SEQ ID NO: 587 - protein, 18 aa, Corononavirus-HKU1
RESLYGIMVNLLICLQAV

SEQ ID NO: 588 - protein, 11 aa, Corononavirus-HKU1
MLLSTLNYVSI

SEQ ID NO: 589 - protein, 4 aa, Corononavirus-HKU1
ILQH

SEQ ID NO: 590 - protein, 10 aa, Corononavirus-HKU1
LFLLICVFYI

SEQ ID NO: 591 - protein, 7 aa, Corononavirus-HKU1
VQGLIKK

SEQ ID NO: 592 - protein, 6 aa, Corononavirus-HKU1
LQVLLF

SEQ ID NO: 593 - protein, 10 aa, Corononavirus-HKU1
DSGYHLVVFL

SEQ ID NO: 594 - protein, 7 aa, Corononavirus-HKU1
THLLAIV

SEQ ID NO: 595 - protein, 7 aa, Corononavirus-HKU1
LLILEIV

SEQ ID NO: 596 - protein, 9 aa, Corononavirus-HKU1
LYHLIVIGI

SEQ ID NO: 597 - protein, 16 aa, Corononavirus-HKU1
YLICMILLLKILVIIM

SEQ ID NO: 598 - protein, 11 aa, Corononavirus-HKU1
VRMGFLLTFVI

SEQ ID NO: 599 - protein, 10 aa, Corononavirus-HKU1
FVINYLWVVV

SEQ ID NO: 600 - protein, 13 aa, Corononavirus-HKU1
KLQSFLGMLIYIN

SEQ ID NO: 601 - protein, 12 aa, Corononavirus-HKU1
VVLHFGQFFVLM

SEQ ID NO: 602 - protein, 8 aa, Corononavirus-HKU1
MLLLVKGF

SEQ ID NO: 603 - protein, 9 aa, Corononavirus-HKU1
ITWVNLLLK

SEQ ID NO: 604 - protein, 27 aa, Corononavirus-HKU1
MAMLCMLTICFGEIVQHGMAVLIVYLI

SEQ ID NO: 605 - protein, 4 aa, Corononavirus-HKU1
LNFL

SEQ ID NO: 606 - protein, 9 aa, Corononavirus-HKU1
NWLALLLLI

SEQ ID NO: 607 - protein, 4 aa, Corononavirus-HKU1
DQIN

SEQ ID NO: 608 - protein, 10 aa, Corononavirus-HKU1
FILLLKEVNY

SEQ ID NO: 609 - protein, 14 aa, Corononavirus-HKU1
FAIRVKRFLLVIVL

SEQ ID NO: 610 - protein, 6 aa, Corononavirus-HKU1
ILVRSH

SEQ ID NO: 611 - protein, 387 aa, Corononavirus-HKU1
TMLIIFLFFYFCYGFNEPLNVVSHLNHDWFLFGDSRSDCNHINNLKIKNFDYLDIHPSLCNNGKISSSAGDSIFKSFHFTRFYNYTGEGDQIIFYEGVNFNPYHRFKCFPNGSNDVWLLNKVRFYRALYSNMAFFRYLTFVDIPYNVSLSKFNSCKSDILSLNNPIFINYSKEVYFTLLGCSLYLVPLCLFKSNFSQYYYNIDTGSVYGFSNVVYPDLDCIYISLKPGSYKVSTTAPFLSLPTKALCFDKSKQFVPVQVVDSRWNNERASDISLSVACQLPYCYFRNSSANYVGKYDINHGDSGFISILSGLLYNVSCISYYGVFLYDNFTSIWPYYSFGRCPTSSIIKHPICVYDFLPIILQGILLCLALLFVVFLLFLLYNDKSH

SEQ ID NO: 612 - protein, 8 aa, Corononavirus-HKU1
LFLFCLQH

SEQ ID NO: 613 - protein, 12 aa, Corononavirus-HKU1
VILIVLILLLMI

SEQ ID NO: 614 - protein, 6 aa, Corononavirus-HKU1
TPQFLA

SEQ ID NO: 615 - protein, 21 aa, Corononavirus-HKU1
VSMLWMFLMVWVHIIYLIVFI

SEQ ID NO: 616 - protein, 21 aa, Corononavirus-HKU1
ILLYYLLVISLNLVPILGIYL

SEQ ID NO: 617 - protein, 5 aa, Corononavirus-HKU1
KVLHI

SEQ ID NO: 618 - protein, 38 aa, Corononavirus-HKU1
VLFGIRNPFYLILIMVFFLELRILSCMLIKLCIVSLVL

SEQ ID NO: 619 - protein, 113 aa, Corononavirus-HKU1
VVFLLTTLILLLFNLIMVFWRLQLVNTLCVSILILFVNLKVVLVMNLGILINLNLCVCSRKILLIMFLQIGCIFIFIKNVALFMLIMLILACLLLFYLVCILVLFYLIIMFCL

SEQ ID NO: 620 - protein, 115 aa, Corononavirus-HKU1
LVMLYLLILIMRLYNIGSHLCLNANIFLNLTTVVLLLMLLIVLVVSLARFNVKLNLYYLILVFMTYLVLLLSLLQLYIVVFLIYLIVTLINGLTILMYPHLLIGNVKFFLIATLI

SEQ ID NO: 621 - protein, 5 aa, Corononavirus-HKU1
VLCFV

SEQ ID NO: 622 - protein, 25 aa, Corononavirus-HKU1
FILILFLVIILMNLRYMVVVLRVLF

SEQ ID NO: 623 - protein, 66 aa, Corononavirus-HKU1
INLPYPTPDDLICSWAVLVFCNLLIIKLTLLLVLVNCIIVCLQLMLLLIIIILLLGIEGMVLIILI

SEQ ID NO: 624 - protein, 69 aa, Corononavirus-HKU1
ALIVLFTHVIVFLLIILFVLVLNLLLLQVARVINHLLLPVLLVLIIVLVRVLLYSTTLTGVGVLVYLIL

SEQ ID NO: 625 - protein, 49 aa, Corononavirus-HKU1
LLMTLGLVLKKSLWLVLVNIVQGSVLMKKSVVYWMDHIMFLVFVVLMPF

SEQ ID NO: 626 - protein, 20 aa, Corononavirus-HKU1
VGLMTLASVTTVVIFFLILF

SEQ ID NO: 627 - protein, 100 aa, Corononavirus-HKU1
MVSIVVPLVLMIYCSLILKFLLMFVLITTFMVLQDKVFLKKFLLFIIIVGKIFCMILMATLLVLKILLLIKHIIFSLVMQEEFLLLFIKMLPLWLYFIVI

SEQ ID NO: 628 - protein, 5 aa, Corononavirus-HKU1
NVAMF

SEQ ID NO: 629 - protein, 4 aa, Corononavirus-HKU1
IIFL

SEQ ID NO: 630 - protein, 18 aa, Corononavirus-HKU1
LLSHILIVILVAFLMLII

SEQ ID NO: 631 - protein, 72 aa, Corononavirus-HKU1
LIILFLLVLFAWVVVFVLIITHLLLPLRVVNVEVFLLLIVLLLLNPLMSVLLMTVLSLWVVFMRSKFPLTLL

SEQ ID NO: 632 - protein, 46 aa, Corononavirus-HKU1
LVKRNLFKLILLKLLLIVLYLSVLIMQLAMTYCQSMALFVIILIVF

SEQ ID NO: 633 - protein, 13 aa, Corononavirus-HKU1
MKLMVYLILLNCM

SEQ ID NO: 634 - protein, 29 aa, Corononavirus-HKU1
LILLCKVSHLAPILILICILMLIILILNP

SEQ ID NO: 635 - protein, 111 aa, Corononavirus-HKU1
VHTAVLLLVLFLKIYCLTKLNFQMLVLLKLITIVLVVVKLEIFFVYNPLMVLKFCLLFCLNLKFLVTPQPLLLLLCFHHGQQQLAYHFLLMYNIELMVWVLLWMFLIKIKS

SEQ ID NO: 636 - protein, 63 aa, Corononavirus-HKU1
LLLLIMLFFLFRMVLVLPTLHLLKYKVLLILMLKHLIVCYSNYLINLVQLVLLYKKFYLVSML

SEQ ID NO: 637 - protein, 13 aa, Corononavirus-HKU1
RLRFRLIGLLMVV

SEQ ID NO: 638 - protein, 13 aa, Corononavirus-HKU1
MLMSLNSLVIFLL

SEQ ID NO: 639 - protein, 5 aa, Corononavirus-HKU1
NLVLL

SEQ ID NO: 640 - protein, 27 aa, Corononavirus-HKU1
LWRRLMSVLKVNLLVLIFVVMVIIFCH

SEQ ID NO: 641 - protein, 23 aa, Corononavirus-HKU1
FKMLLMVCCLCILVINLFLLKLF

SEQ ID NO: 642 - protein, 9 aa, Corononavirus-HKU1
VLVCVYQVM

SEQ ID NO: 643 - protein, 36 aa, Corononavirus-HKU1
VLHLNKGILLNIMIIGCSLVVLTIILNQFQIKMLFL

SEQ ID NO: 644 - protein, 14 aa, Corononavirus-HKU1
ILVLLILLKRLLFI

SEQ ID NO: 645 - protein, 27 aa, Corononavirus-HKU1
IILYQNCLILNLSYLIGLKIKHPLRLI

SEQ ID NO: 646 - protein, 9 aa, Corononavirus-HKU1
IFILLMLLF

SEQ ID NO: 647 - protein, 5 aa, Corononavirus-HKU1
ICIMR

SEQ ID NO: 648 - protein, 9 aa, Corononavirus-HKU1
ILFKSLLSL

SEQ ID NO: 649 - protein, 9 aa, Corononavirus-HKU1
IIVISILKI

SEQ ID NO: 650 - protein, 6 aa, Corononavirus-HKU1
VHMKCM

SEQ ID NO: 651 - protein, 8 aa, Corononavirus-HKU1
NGLGMFGY

SEQ ID NO: 652 - protein, 5 aa, Corononavirus-HKU1
FLFHL

SEQ ID NO: 653 - protein, 63 aa, Corononavirus-HKU1
YSLYCSFLYVVVLVVVLHVLVNVIIVVMSMVVIMILLSKHLMMIRISCQISLNLNFIYGRLET

SEQ ID NO: 654 - protein, 7 aa, Corononavirus-HKU1
LHTFSCY

SEQ ID NO: 655 - protein, 7 aa, Corononavirus-HKU1
RIWCYKP

SEQ ID NO: 656 - protein, 6 aa, Corononavirus-HKU1
RFVSKV

SEQ ID NO: 657 - protein, 30 aa, Corononavirus-HKU1
LLSTYCWLLYCTFKCLVSQVWQICFSLYIT

SEQ ID NO: 658 - protein, 5 aa, Corononavirus-HKU1
SRYFP

SEQ ID NO: 659 - protein, 5 aa, Corononavirus-HKU1
FWCCN

SEQ ID NO: 660 - protein, 5 aa, Corononavirus-HKU1
FYYLW

SEQ ID NO: 661 - protein, 9 aa, Corononavirus-HKU1
IYCLACRGT

SEQ ID NO: 662 - protein, 13 aa, Corononavirus-HKU1
VWLIYFSMILLGT

SEQ ID NO: 663 - protein, 7 aa, Corononavirus-HKU1
FYFVLFL

SEQ ID NO: 664 - protein, 6 aa, Corononavirus-HKU1
SLLLLF

SEQ ID NO: 665 - protein, 46 aa, Corononavirus-HKU1
QLLSFVCNFVVFVISLLFHLRLTFIKEVCSCISLIVNKLYHPLQII

SEQ ID NO: 666 - protein, 7 aa, Corononavirus-HKU1
SKSKHYE

SEQ ID NO: 667 - protein, 8 aa, Corononavirus-HKU1
IFSSSIYF

SEQ ID NO: 668 - protein, 31 aa, Corononavirus-HKU1
SSCYILKRMEFLFGCNTTFYYYHIAVRLYEP

SEQ ID NO: 669 - protein, 24 aa, Corononavirus-HKU1
YVCLSYQDDYSLAYVAIDYHLDYI

SEQ ID NO: 670 - protein, 6 aa, Corononavirus-HKU1
LFLCFE

SEQ ID NO: 671 - protein, 22 aa, Corononavirus-HKU1
CFSCIFYSVYYYFYCYMDSLFC

SEQ ID NO: 672 - protein, 5 aa, Corononavirus-HKU1
YSAFY

SEQ ID NO: 673 - protein, 7 aa, Corononavirus-HKU1
NWQLVEF

SEQ ID NO: 674 - protein, 4 aa, Corononavirus-HKU1
SRDQ

SEQ ID NO: 675 - protein, 4 aa, Corononavirus-HKU1
SYVY

SEQ ID NO: 676 - protein, 7 aa, Corononavirus-HKU1
YERQDVC

SEQ ID NO: 677 - protein, 37 aa, Corononavirus-HKU1
GLSHINCYCYSWSSLYTGCQTWHWLYSFRFARICYCS

SEQ ID NO: 678 - protein, 7 aa, Corononavirus-HKU1
GASTLYL

SEQ ID NO: 679 - protein, 5 aa, Corononavirus-HKU1
TCLFR

SEQ ID NO: 680 - protein, 6 aa, Corononavirus-HKU1
WFCCFC

SEQ ID NO: 681 - protein, 5 aa, Corononavirus-HKU1
LSFTV

SEQ ID NO: 682 - protein, 14 aa, Corononavirus-HKU1
WYGYCLVKSLNLNY

SEQ ID NO: 683 - protein, 11 aa, Corononavirus-HKU1
DVLYSRSLCWK

SEQ ID NO: 684 - protein, 16 aa, Corononavirus-HKU1
KLLWKSFRNPQENFLG

SEQ ID NO: 685 - protein, 6 aa, Corononavirus-HKU1
AKLPNL

SEQ ID NO: 686 - protein, 6 aa, Corononavirus-HKU1
RQKNPT

SEQ ID NO: 687 - protein, 27 aa, Corononavirus-HKU1
IHCVYSTTRKYYPTLFLVLRDHSISKR

SEQ ID NO: 688 - protein, 16 aa, Corononavirus-HKU1
IFRWSRSSHCFRSTPF

SEQ ID NO: 689 - protein, 6 aa, Corononavirus-HKU1
SKRILV

SEQ ID NO: 690 - protein, 6 aa, Corononavirus-HKU1
TQPAFF

SEQ ID NO: 691 - protein, 26 aa, Corononavirus-HKU1
WSTKAVVTEMVFLLSRYRPICQCILW

SEQ ID NO: 692 - protein, 9 aa, Corononavirus-HKU1
IPRRGLLGC

SEQ ID NO: 693 - protein, 20 aa, Corononavirus-HKU1
HFYSLRCFVKGSYYSRSYPY

SEQ ID NO: 694 - protein, 13 aa, Corononavirus-HKU1
VSAWYDFASRLLC

SEQ ID NO: 695 - protein, 7 aa, Corononavirus-HKU1
RLRKVCF

SEQ ID NO: 696 - protein, 12 aa, Corononavirus-HKU1
STRFTFSITWTQ

SEQ ID NO: 697 - protein, 4 aa, Corononavirus-HKU1
SFIK

SEQ ID NO: 698 - protein, 8 aa, Corononavirus-HKU1
TFRFYSKT

SEQ ID NO: 699 - protein, 7 aa, Corononavirus-HKU1
SCFSQAW

SEQ ID NO: 700 - protein, 5 aa, Corononavirus-HKU1
TSASH

SEQ ID NO: 701 - protein, 8 aa, Corononavirus-HKU1
AKCQGNQA

SEQ ID NO: 702 - protein, 11 aa, Corononavirus-HKU1
NFNKTSPKANS

SEQ ID NO: 703 - protein, 6 aa, Corononavirus-HKU1
CSTVFW

SEQ ID NO: 704 - protein, 8 aa, Corononavirus-HKU1
KRTFSKFW

SEQ ID NO: 705 - protein, 6 aa, Corononavirus-HKU1
NVKAWY

SEQ ID NO: 706 - protein, 20 aa, Corononavirus-HKU1
SSVSYSCRISSYTRCFFLWF

SEQ ID NO: 707 - protein, 4 aa, Corononavirus-HKU1
IRLG

SEQ ID NO: 708 - protein, 5 aa, Corononavirus-HKU1
KRFRG

SEQ ID NO: 709 - protein, 7 aa, Corononavirus-HKU1
TSLFWFY

SEQ ID NO: 710 - protein, 5 aa, Corononavirus-HKU1
YFTRL

SEQ ID NO: 711 - protein, 6 aa, Corononavirus-HKU1
DNYESS

SEQ ID NO: 712 - protein, 7 aa, Corononavirus-HKU1
REFKCLR

SEQ ID NO: 713 - protein, 4 aa, Corononavirus-HKU1
FVEF

SEQ ID NO: 714 - protein, 6 aa, Corononavirus-HKU1
TITRTV

SEQ ID NO: 715 - protein, 10 aa, Corononavirus-HKU1
FKCWYSAHFK

SEQ ID NO: 716 - protein, 5 aa, Corononavirus-HKU1
FTCYS

SEQ ID NO: 717 - protein, 34 aa, Corononavirus-HKU1
SLCRRLCCLMRMNPNSTLGGNPSLLFGIGHSLSE

SEQ ID NO: 718 - protein, 17 aa, Corononavirus-HKU1
ILAVITDRVGCYRLYIN

SEQ ID NO: 719 - protein, 4 aa, Corononavirus-HKU1
KFYI

SEQ ID NO: 720 - protein, 4 aa, Corononavirus-HKU1
TFDC

SEQ ID NO: 721 - protein, 5 aa, Corononavirus-HKU1
SSYKV

SEQ ID NO: 722 - protein, 19 aa, Corononavirus-HKU1
YKRLREELSIVVFNIYISI

SEQ ID NO: 723 - protein, 16 aa, Corononavirus-HKU1
LKLIIAFWRNYKKKKK

SEQ ID NO: 724 - DNA, 29942 bp, Corononavirus-HKU1; identical to SEQ ID NO: 3
  CDS (3)..(29942)

SEQ ID NO: 725 - protein, 34 aa, Corononavirus-HKU1
IRANCVRTVYQLTISCQISLNLNFLNKIPCYPCL

SEQ ID NO: 726 - protein, 19 aa, Corononavirus-HKU1
VWFNHNLVFYFPHFSSLCQ

SEQ ID NO: 727 - protein, 13 aa, Corononavirus-HKU1
RVGCPQRPSHRSQ

SEQ ID NO: 728 - protein, 30 aa, Corononavirus-HKU1
LKPANTVSASSGRQNFVGCFRMQRRSWLVL

SEQ ID NO: 729 - protein, 25 aa, Corononavirus-HKU1
SQMRVGYAPLLVKRWKVLDSFMIIM

SEQ ID NO: 730 - protein, 28 aa, Corononavirus-HKU1
IVAAFLDKNGMCSQILSVIFLFMKIYML

SEQ ID NO: 731 - protein, 4 aa, Corononavirus-HKU1
LKQP

SEQ ID NO: 732 - protein, 6 aa, Corononavirus-HKU1
SPVRQF

SEQ ID NO: 733 - protein, 34 aa, Corononavirus-HKU1
LNHLCIAWVVFLKGMLWACSVHTRLNVMLYIIFL

SEQ ID NO: 734 - protein, 40 aa, Corononavirus-HKU1
LHLLLILVKIFWVGLYLLVLCHLMFTNGFNSVGCILKRVI

SEQ ID NO: 735 - protein, 12 aa, Corononavirus-HKU1
FQILNLMIMILV

SEQ ID NO: 736 - protein, 34 aa, Corononavirus-HKU1
KMLMLRFMLSLKVNIHKKLMLYLDNIVVLNPYFL

SEQ ID NO: 737 - protein, 10 aa, Corononavirus-HKU1
TSMVVTILVN

SEQ ID NO: 738 - protein, 14 aa, Corononavirus-HKU1
QIVFKLMVIILCKI

SEQ ID NO: 739 - protein, 15 aa, Corononavirus-HKU1
DKSSLYGLPIVTLIL

SEQ ID NO: 740 - protein, 4 aa, Corononavirus-HKU1
WLGM

SEQ ID NO: 741 - protein, 12 aa, Corononavirus-HKU1
FVIHDLLCACRL

SEQ ID NO: 742 - protein, 15 aa, Corononavirus-HKU1
LLFVVLNMLHNLQKM

SEQ ID NO: 743 - protein, 13 aa, Corononavirus-HKU1
LYVNLYIYYLLMQ

SEQ ID NO: 744 - protein, 4 aa, Corononavirus-HKU1
SFLV

SEQ ID NO: 745 - protein, 27 aa, Corononavirus-HKU1
LIWMIFLLNLYIMLICVIVVLLCSMVM

SEQ ID NO: 746 - protein, 16 aa, Corononavirus-HKU1
IVLMIIVIFMVGFQVI

SEQ ID NO: 747 - protein, 70 aa, Corononavirus-HKU1
WMVFLVHCVVQFMTLAKLKPNHLVLFLKILCYLLIVLILLTMILLICMVILSHHLVLVYIGRRVLDCGFL

SEQ ID NO: 748 - protein, 15 aa, Corononavirus-HKU1
LNLQSSLMMIWFIQV

SEQ ID NO: 749 - protein, 17 aa, Corononavirus-HKU1
VVNLLLKKLLLLLMHFT

SEQ ID NO: 750 - protein, 36 aa, Corononavirus-HKU1
IMFNVSVVILNKIIFLALIILGVGNCCLIEVIIICF

SEQ ID NO: 751 - protein, 28 aa, Corononavirus-HKU1
KILTCLLSVVLILLASLQFVEMVLYLFY

SEQ ID NO: 752 - protein, 6 aa, Corononavirus-HKU1
FPVVII

SEQ ID NO: 753 - protein, 9 aa, Corononavirus-HKU1
FRVVFSLHL

SEQ ID NO: 754 - protein, 12 aa, Corononavirus-HKU1
CLNFHKKFLICV

SEQ ID NO: 755 - protein, 16 aa, Corononavirus-HKU1
KCVFCLWTEFQLLHFI

SEQ ID NO: 756 - protein, 29 aa, Corononavirus-HKU1
SIMLIGWLLNLSYWVLHLLIKWLIGLIPC

SEQ ID NO: 757 - protein, 14 aa, Corononavirus-HKU1
MLVHLLQAGFFTNY

SEQ ID NO: 758 - protein, 4 aa, Corononavirus-HKU1
MVFL

SEQ ID NO: 759 - protein, 10 aa, Corononavirus-HKU1
YLKPTLILLL

SEQ ID NO: 760 - protein, 7 aa, Corononavirus-HKU1
YLIMLKF

SEQ ID NO: 761 - protein, 11 aa, Corononavirus-HKU1
LINFTLFLSYY

SEQ ID NO: 762 - protein, 7 aa, Corononavirus-HKU1
SVLQLMF

SEQ ID NO: 763 - protein, 11 aa, Corononavirus-HKU1
KICLFLKLLMV

SEQ ID NO: 764 - protein, 10 aa, Corononavirus-HKU1
AISFITLVQG

SEQ ID NO: 765 - protein, 25 aa, Corononavirus-HKU1
FLVLFYHVMHRNNKFIFLKALQNLL

SEQ ID NO: 766 - protein, 23 aa, Corononavirus-HKU1
KMMLLRMSNLLYHLMSIVNHLNL

SEQ ID NO: 767 - protein, 5 aa, Corononavirus-HKU1
KKFVL

SEQ ID NO: 768 - protein, 16 aa, Corononavirus-HKU1
IICTWVSVVINFSLLS

SEQ ID NO: 769 - protein, 7 aa, Corononavirus-HKU1
MIKIFVF

SEQ ID NO: 770 - protein, 26 aa, Corononavirus-HKU1
IRLGVFHVQVEKLILTRNLLLWRFRL

SEQ ID NO: 771 - protein, 7 aa, Corononavirus-HKU1
QLRLCLI

SEQ ID NO: 772 - protein, 7 aa, Corononavirus-HKU1
ILLLMIF

SEQ ID NO: 773 - protein, 8 aa, Corononavirus-HKU1
VKFVQNLK

SEQ ID NO: 774 - protein, 5 aa, Corononavirus-HKU1
KRVLL

SEQ ID NO: 775 - protein, 10 aa, Corononavirus-HKU1
MILLLLFVML

SEQ ID NO: 776 - protein, 16 aa, Corononavirus-HKU1
TLVKSIQWLVIKFVHF

SEQ ID NO: 777 - protein, 214 aa, Corononavirus-HKU1
INLMRMLFIYLMRLVMKQWPLVCIVLLLLRMLKTLSVVKLSKILLMVSLKTLLMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTITMKRLLLVTMMTKLLLLVMM

SEQ ID NO: 778 - protein, 15 aa, Corononavirus-HKU1
MILKVFMTLILIKLF

SEQ ID NO: 779 - protein, 46 aa, Corononavirus-HKU1
FLMMSIMMLCLLVMVLVLKQKHILKLMVYGHLLLHILIVGCVLCYL

SEQ ID NO: 780 - protein, 10 aa, Corononavirus-HKU1
CRNYLLSLRI

SEQ ID NO: 781 - protein, 21 aa, Corononavirus-HKU1
LLKICGYLIRWVIIKVLLIIY

SEQ ID NO: 782 - protein, 14 aa, Corononavirus-HKU1
PLFLKLLFCLKVVL

SEQ ID NO: 783 - protein, 7 aa, Corononavirus-HKU1
LILLIGF

SEQ ID NO: 784 - protein, 13 aa, Corononavirus-HKU1
TSLILMRMLIGVV

SEQ ID NO: 785 - protein, 7 aa, Corononavirus-HKU1
NVVFLLI

SEQ ID NO: 786 - protein, 22 aa, Corononavirus-HKU1
MVWMLCFFMEILCLMFVSVDII

SEQ ID NO: 787 - protein, 34 aa, Corononavirus-HKU1
QRTYLVHYIFHYLMTIFVLFAPLKKFLLLHVLWM

SEQ ID NO: 788 - protein, 5 aa, Corononavirus-HKU1
TFVIL

SEQ ID NO: 789 - protein, 4 aa, Corononavirus-HKU1
VMNK

SEQ ID NO: 790 - protein, 15 aa, Corononavirus-HKU1
MVSLLLNLVVINLIL

SEQ ID NO: 791 - protein, 20 aa, Corononavirus-HKU1
VMECHLVCLLLSYLNCMVCV

SEQ ID NO: 792 - protein, 11 aa, Corononavirus-HKU1
HLMYVLLKVIL

SEQ ID NO: 793 - protein, 28 aa, Corononavirus-HKU1
MLLDLLKLMLLLILLMGICSMVVELQKL

SEQ ID NO: 794 - protein, 21 aa, Corononavirus-HKU1
LQVKNFLKKLLLWLNLKVFAK

SEQ ID NO: 795 - protein, 18 aa, Corononavirus-HKU1
EIVMFLPVVNYVKQFLIL

SEQ ID NO: 796 - protein, 14 aa, Corononavirus-HKU1
ALMLDKMEDNLMFC

SEQ ID NO: 797 - protein, 30 aa, Corononavirus-HKU1
HVLISILIIMIVVCLLSYRLVYLVFLLMCH

SEQ ID NO: 798 - protein, 37 aa, Corononavirus-HKU1
VLLINKLSLLVIIKKILILFKNVKLLQLLVLKHWLLD

SEQ ID NO: 799 - protein, 14 aa, Corononavirus-HKU1
AVLLNLRQMHTNFF

SEQ ID NO: 800 - protein, 24 aa, Corononavirus-HKU1
VVMIVLFQILLLYKKFYCFVMIYN

SEQ ID NO: 801 - protein, 11 aa, Corononavirus-HKU1
IMTFVIICCLR

SEQ ID NO: 802 - protein, 59 aa, Corononavirus-HKU1
LVFLKIGVLSINLMLLTVLKLLSILSVLILFIYVVRVKTLVMYVMVLFIKQLLIKFVFY

SEQ ID NO: 803 - protein, 5 aa, Corononavirus-HKU1
MFCLL

SEQ ID NO: 804 - protein, 11 aa, Corononavirus-HKU1
MVLILNLFLLL

SEQ ID NO: 805 - protein, 20 aa, Corononavirus-HKU1
VKFLVKYLVMFSVMALMLLS

SEQ ID NO: 806 - protein, 18 aa, Corononavirus-HKU1
SVVIFMPIKFYISMKICL

SEQ ID NO: 807 - protein, 23 aa, Corononavirus-HKU1
LIFLLYKVHLGLISNNCLLIIIF

SEQ ID NO: 808 - protein, 6 aa, Corononavirus-HKU1
QYVNGL

SEQ ID NO: 809 - protein, 17 aa, Corononavirus-HKU1
LLTVHFFLLNSLIIIVM

SEQ ID NO: 810 - protein, 31 aa, Corononavirus-HKU1
LVLCCSILILNLINGSGRKHGMNFVLADHIG

SEQ ID NO: 811 - protein, 4 aa, Corononavirus-HKU1
LLLF

SEQ ID NO: 812 - protein, 20 aa, Corononavirus-HKU1
LKVILNLMNHQMLLILFVLF

SEQ ID NO: 813 - protein, 11 aa, Corononavirus-HKU1
NKLIYQVQFVN

SEQ ID NO: 814 - protein, 24 aa, Corononavirus-HKU1
NLFVIVVLNKKVVLVLMLLCILVH

SEQ ID NO: 815 - protein, 24 aa, Corononavirus-HKU1
QRLIFLMVIRLAVIVQVELSIVLN

SEQ ID NO: 816 - protein, 4 aa, Corononavirus-HKU1
MYHF

SEQ ID NO: 817 - protein, 6 aa, Corononavirus-HKU1
FVLILL

SEQ ID NO: 818 - protein, 16 aa, Corononavirus-HKU1
VRIYLMMLLQLTCLWV

SEQ ID NO: 819 - protein, 5 aa, Corononavirus-HKU1
AIIHI

SEQ ID NO: 820 - protein, 23 aa, Corononavirus-HKU1
NVVHLTNIMMLVVLKNIQVLVVV

SEQ ID NO: 821 - protein, 8 aa, Corononavirus-HKU1
LTACILKI

SEQ ID NO: 822 - protein, 7 aa, Corononavirus-HKU1
PRLLHLC

SEQ ID NO: 823 - protein, 32 aa, Corononavirus-HKU1
LIIFWMMLKWLLITLIFHNIIVIMVSIIQNLL

SEQ ID NO: 824 - protein, 18 aa, Corononavirus-HKU1
RLSLNHLLKLTVFILTLS

SEQ ID NO: 825 - protein, 8 aa, Corononavirus-HKU1
LDMIFVLN

SEQ ID NO: 826 - protein, 8 aa, Corononavirus-HKU1
ICRLLSTK

SEQ ID NO: 827 - protein, 4 aa, Corononavirus-HKU1
QSGL

SEQ ID NO: 828 - protein, 13 aa, Corononavirus-HKU1
LLVMLFWHLMIYM

SEQ ID NO: 829 - protein, 23 aa, Corononavirus-HKU1
NVILKDVKLLVSLLFGFVMMKHH

SEQ ID NO: 830 - protein, 48 aa, Corononavirus-HKU1
ILLLILINLVLNLKIDIVFCLLILYLRSHKVMWLLLLWNRRLVLKRLS

SEQ ID NO: 831 - protein, 8 aa, Corononavirus-HKU1
RVLERLLK

SEQ ID NO: 832 - protein, 20 aa, Corononavirus-HKU1
KMLLLLMMKIVLLRLLKVYL

SEQ ID NO: 833 - protein, 7 aa, Corononavirus-HKU1
LMFGICI

SEQ ID NO: 834 - protein, 15 aa, Corononavirus-HKU1
QVVIMLFGLLMNCHA

SEQ ID NO: 835 - protein, 20 aa, Corononavirus-HKU1
LNHQQLGNIYDMVLNLLLYL

SEQ ID NO: 836 - protein, 4 aa, Corononavirus-HKU1
ICYV

SEQ ID NO: 837 - protein, 7 aa, Corononavirus-HKU1
EMIIKLF

SEQ ID NO: 838 - protein, 9 aa, Corononavirus-HKU1
FLKFLKQEL

SEQ ID NO: 839 - protein, 5 aa, Corononavirus-HKU1
NFMVF

SEQ ID NO: 840 - protein, 24 aa, Corononavirus-HKU1
SGCLFMFLVYYILQMIKPFFILQK

SEQ ID NO: 841 - protein, 25 aa, Corononavirus-HKU1
LLSLLLICFVWLLKMLFRHLDGVYL

SEQ ID NO: 842 - protein, 5 aa, Corononavirus-HKU1
KVFLL

SEQ ID NO: 843 - protein, 12 aa, Corononavirus-HKU1
PLCFCFGLIFCI

SEQ ID NO: 844 - protein, 25 aa, Corononavirus-HKU1
MLFLVTFIFLILVFFLFLWEELLCG

SEQ ID NO: 845 - protein, 15 aa, Corononavirus-HKU1
RLLLVWLQFVIFILS

SEQ ID NO: 846 - protein, 28 aa, Corononavirus-HKU1
VLQVIFVMVVLYVNCVILVLICWIHMQL

SEQ ID NO: 847 - protein, 6 aa, Corononavirus-HKU1
ILFSMK

SEQ ID NO: 848 - protein, 10 aa, Corononavirus-HKU1
IDVFYLIMLV

SEQ ID NO: 849 - protein, 36 aa, Corononavirus-HKU1
LLNSLLVIHYTQYGFIHYFVLLVYNYLLHGCLICLC

SEQ ID NO: 850 - protein, 5 aa, Corononavirus-HKU1
KLCIG

SEQ ID NO: 851 - protein, 6 aa, Corononavirus-HKU1
LDLLYL

SEQ ID NO: 852 - protein, 13 aa, Corononavirus-HKU1
LICYLLLSCCGFI

SEQ ID NO: 853 - protein, 7 aa, Corononavirus-HKU1
LLLLCIK

SEQ ID NO: 854 - protein, 36 aa, Corononavirus-HKU1
LVLLGILSMVVIKLVVYFVINEIVVFVLSVVLLLVV

SEQ ID NO: 855 - protein, 34 aa, Corononavirus-HKU1
FVIMILLLMVVLVFVLNINGIVLIAILLNQVTLL

SEQ ID NO: 856 - protein, 9 aa, Corononavirus-HKU1
NFLKSLNDL

SEQ ID NO: 857 - protein, 8 aa, Corononavirus-HKU1
IQLMLHIM

SEQ ID NO: 858 - protein, 9 aa, Corononavirus-HKU1
LLILSKLVV

SEQ ID NO: 859 - protein, 21 aa, Corononavirus-HKU1
CVCSMIEMDSVFTMMLMLVYL

SEQ ID NO: 860 - protein, 17 aa, Corononavirus-HKU1
ILIICYILKLKLFLICM

SEQ ID NO: 861 - protein, 9 aa, Corononavirus-HKU1
RVMLIELIF

SEQ ID NO: 862 - protein, 16 aa, Corononavirus-HKU1
MLLCFMHNHCIGLYYL

SEQ ID NO: 863 - protein, 9 aa, Corononavirus-HKU1
LLQLVMVSL

SEQ ID NO: 864 - protein, 39 aa, Corononavirus-HKU1
PRLCLMFMLILLCLILMLIERVLIILLTLLMLLLERVCN

SEQ ID NO: 865 - protein, 25 aa, Corononavirus-HKU1
ILLWDVYVNVVPLIQMLKQDLLLNL

SEQ ID NO: 866 - protein, 18 aa, Corononavirus-HKU1
LLVWNLLMKIITIWYLHI

SEQ ID NO: 867 - protein, 5 aa, Corononavirus-HKU1
RVIIL

SEQ ID NO: 868 - protein, 40 aa, Corononavirus-HKU1
VFLYRMVLSMYRVMLLRQLIFLVYGLLMLLINLLLIYSIN

SEQ ID NO: 869 - protein, 8 aa, Corononavirus-HKU1
KKHVLKLA

SEQ ID NO: 870 - protein, 23 aa, Corononavirus-HKU1
LLISKRQVSLFLQHPFHLKEVLY

SEQ ID NO: 871 - protein, 11 aa, Corononavirus-HKU1
VICYIYYFLLV

SEQ ID NO: 872 - protein, 74 aa, Corononavirus-HKU1
SVLYYCGLYCLHIVFISLIFICLLMLVLKLLIMVLLEIFQLMIYVLLINFSNLINGMSPLLGLFTIIILWIALL

SEQ ID NO: 873 - protein, 19 aa, Corononavirus-HKU1
WQLWMKISVLLCLMFLLKF

SEQ ID NO: 874 - protein, 9 aa, Corononavirus-HKU1
DMAFMFYIF

SEQ ID NO: 875 - protein, 53 aa, Corononavirus-HKU1
LMHLLVIVFSAIHHIFRFLIMIFMLVVVFYHLCVLCLKEVMVHHILIVIQMVL

SEQ ID NO: 876 - protein, 23 aa, Corononavirus-HKU1
RMLLCIHLWFHIHVIALLILMVL

SEQ ID NO: 877 - protein, 13 aa, Corononavirus-HKU1
DFLMLLVKVLYVL

SEQ ID NO: 878 - protein, 4 aa, Corononavirus-HKU1
ERAL

SEQ ID NO: 879 - protein, 24 aa, Corononavirus-HKU1
LIVEWVHVNTPKRVYVLILIVPGF

SEQ ID NO: 880 - protein, 27 aa, Corononavirus-HKU1
IMIIIEVCLELFVVEIFLICFINFLVV

SEQ ID NO: 881 - protein, 16 aa, Corononavirus-HKU1
ISFLLLLVLFLELYWL

SEQ ID NO: 882 - protein, 8 aa, Corononavirus-HKU1
LLSWFFII

SEQ ID NO: 883 - protein, 12 aa, Corononavirus-HKU1
NLSVLLEIILVL

SEQ ID NO: 884 - protein, 31 aa, Corononavirus-HKU1
MLLFGVLIFLCFLFFKFILFVHVFMLVFIFM

SEQ ID NO: 885 - protein, 9 aa, Corononavirus-HKU1
HCIFLLKLV

SEQ ID NO: 886 - protein, 12 aa, Corononavirus-HKU1
LCICNGLLCMVL

SEQ ID NO: 887 - protein, 9 aa, Corononavirus-HKU1
CLFGFVSHM

SEQ ID NO: 888 - protein, 36 aa, Corononavirus-HKU1
LWLLQTMFYGYFHIVGKLVLMYVVIVHLKKHLLLLL

SEQ ID NO: 889 - protein, 8 aa, Corononavirus-HKU1
LLKILIVD

SEQ ID NO: 890 - protein, 12 aa, Corononavirus-HKU1
RILFLMLPTIDI

SEQ ID NO: 891 - protein, 25 aa, Corononavirus-HKU1
VCIISIVTIVVKWILLPIEKRRVLS

SEQ ID NO: 892 - protein, 33 aa, Corononavirus-HKU1
LKLWKHLITIMVMMSYTNLLQHLFLHLFCNQVL

SEQ ID NO: 893 - protein, 20 aa, Corononavirus-HKU1
RWYLLRQKLNLVLLVLLMVV

SEQ ID NO: 894 - protein, 4 aa, Corononavirus-HKU1
MVYG

SEQ ID NO: 895 - protein, 16 aa, Corononavirus-HKU1
MTKFIVLVMLYVHPLI

SEQ ID NO: 896 - protein, 13 aa, Corononavirus-HKU1
TNLIILPYCVELL

SEQ ID NO: 897 - protein, 4 aa, Corononavirus-HKU1
VILL

SEQ ID NO: 898 - protein, 4 aa, Corononavirus-HKU1
CLVG

SEQ ID NO: 899 - protein, 13 aa, Corononavirus-HKU1
QLCLTRCRAVNLF

SEQ ID NO: 900 - protein, 25 aa, Corononavirus-HKU1
QSLYKILTLQNILLVMLNLVKLLLF

SEQ ID NO: 901 - protein, 36 aa, Corononavirus-HKU1
LRIMADHKGHFMLLCVVVILLKVLFCVGHVDLLVMY

SEQ ID NO: 902 - protein, 12 aa, Corononavirus-HKU1
QVIVLSLYICIN

SEQ ID NO: 903 - protein, 76 aa, Corononavirus-HKU1
SSVLVVTLALILLVIFMVHIEMLKLYSCQLRTTSRLLMLLLGSMQLYLIIVLGLYKMMFVLLKILMFGLWQMVLAK

SEQ ID NO: 904 - protein, 5 aa, Corononavirus-HKU1
KQILS

SEQ ID NO: 905 - protein, 5 aa, Corononavirus-HKU1
MLWLQ

SEQ ID NO: 906 - protein, 24 aa, Corononavirus-HKU1
QVFLLKLYWLLLSVYIWDFKVVKY

SEQ ID NO: 907 - protein, 38 aa, Corononavirus-HKU1
EVVLLKMNWHLLTFINNWLVLNCNLKQKDLLKKQFIGF

SEQ ID NO: 908 - protein, 8 aa, Corononavirus-HKU1
YLHFCLVV

SEQ ID NO: 909 - protein, 16 aa, Corononavirus-HKU1
FLHLLNGLYLCILIHI

SEQ ID NO: 910 - protein, 13 aa, Corononavirus-HKU1
LVLHYVYFVLLVL

SEQ ID NO: 911 - protein, 7 aa, Corononavirus-HKU1
LNISIFI

SEQ ID NO: 912 - protein, 9 aa, Corononavirus-HKU1
FLYSVPCFM

SEQ ID NO: 913 - protein, 21 aa, Corononavirus-HKU1
LFIRKVLEVLLMSGSHILFLL

SEQ ID NO: 914 - protein, 20 aa, Corononavirus-HKU1
ILLMFMKYFMVVFYVFLLFL

SEQ ID NO: 915 - protein, 11 aa, Corononavirus-HKU1
LCIVLIMTFFL

SEQ ID NO: 916 - protein, 6 aa, Corononavirus-HKU1
CFWLVE

SEQ ID NO: 917 - protein, 9 aa, Corononavirus-HKU1
FLCGILGRI

SEQ ID NO: 918 - protein, 11 aa, Corononavirus-HKU1
KRMFCYLLQPF

SEQ ID NO: 919 - protein, 10 aa, Corononavirus-HKU1
VLIHGPLFCH

SEQ ID NO: 920 - protein, 22 aa, Corononavirus-HKU1
QKLLLIGCLLIYFILQMYLILN

SEQ ID NO: 921 - protein, 4 aa, Corononavirus-HKU1
VTYL

SEQ ID NO: 922 - protein, 13 aa, Corononavirus-HKU1
GIFYLVIGDFSLF

SEQ ID NO: 923 - protein, 22 aa, Corononavirus-HKU1
TVFLECLWVFIIIKFLFKNCVI

SEQ ID NO: 924 - protein, 16 aa, Corononavirus-HKU1
MLMAYVHLVIVLRLFC

SEQ ID NO: 925 - protein, 4 aa, Corononavirus-HKU1
NCLE

SEQ ID NO: 926 - protein, 14 aa, Corononavirus-HKU1
VACQLLKSPKFNQN

SEQ ID NO: 927 - protein, 7 aa, Corononavirus-HKU1
NVLMLFC

SEQ ID NO: 928 - protein, 30 aa, Corononavirus-HKU1
IVYSICMLLLILSCGSIVVFYIMKYYLLQI

SEQ ID NO: 929 - protein, 8 aa, Corononavirus-HKU1
LLISLLNY

SEQ ID NO: 930 - protein, 17 aa, Corononavirus-HKU1
LFYSPILLQLILSVLQV

SEQ ID NO: 931 - protein, 21 aa, Corononavirus-HKU1
MKLAMIMFKIVPFCRLCKVSL

SEQ ID NO: 932 - protein, 28 aa, Corononavirus-HKU1
IWLVLLNMKSQRKIWLMLKIVVLLINNR

SEQ ID NO: 933 - protein, 5 aa, Corononavirus-HKU1
KKHVI

SEQ ID NO: 934 - protein, 10 aa, Corononavirus-HKU1
LSLCMNVIKL

SEQ ID NO: 935 - protein, 9 aa, Corononavirus-HKU1
LANLNVWQT

SEQ ID NO: 936 - protein, 37 aa, Corononavirus-HKU1
HLLTCIKRLGLMIRRVKLFPLCRQCFLAWFVNWIIRL

SEQ ID NO: 937 - protein, 13 aa, Corononavirus-HKU1
ILFWIMLLKVVYL

SEQ ID NO: 938 - protein, 10 aa, Corononavirus-HKU1
VLFQHWLLIL

SEQ ID NO: 939 - protein, 37 aa, Corononavirus-HKU1
YQINKFLIKLLIMFMLHMLVVYGIYRLFKMLMVLINS

SEQ ID NO: 940 - protein, 30 aa, Corononavirus-HKU1
LILVLILIGLLLSLRTGIMKLLMLLCRIMS

SEQ ID NO: 941 - protein, 4 aa, Corononavirus-HKU1
CLIN

SEQ ID NO: 942 - protein, 10 aa, Corononavirus-HKU1
KYKLLIVVLI

SEQ ID NO: 943 - protein, 17 aa, Corononavirus-HKU1
IVIFLLNVIIIMVVVVE

SEQ ID NO: 944 - protein, 15 aa, Corononavirus-HKU1
FMLFLVMLMVLSILR

SEQ ID NO: 945 - protein, 8 aa, Corononavirus-HKU1
KMMEIVLF

SEQ ID NO: 946 - protein, 29 aa, Corononavirus-HKU1
SLILLVNFLYKMLRDLKLSIFILLKDVTL

SEQ ID NO: 947 - protein, 36 aa, Corononavirus-HKU1
LEGGLLVLYLQQLDCRLVLLLSMQLILLYFHYVHFL

SEQ ID NO: 948 - protein, 6 aa, Corononavirus-HKU1
ILRKLI

SEQ ID NO: 949 - protein, 9 aa, Corononavirus-HKU1
IIYNKVVYL

SEQ ID NO: 950 - protein, 42 aa, Corononavirus-HKU1
LIVLKCSVIMLVLVWPLLLNLRLLLTKILMVVPQFVFIAVHV

SEQ ID NO: 951 - protein, 4 aa, Corononavirus-HKU1
SIQM

SEQ ID NO: 952 - protein, 16 aa, Corononavirus-HKU1
MVYVNYVVNLYKSLWV

SEQ ID NO: 953 - protein, 7 aa, Corononavirus-HKU1
KILFFMC

SEQ ID NO: 954 - protein, 18 aa, Corononavirus-HKU1
HMMFVKSVVFGEMAVVPV

SEQ ID NO: 955 - protein, 10 aa, Corononavirus-HKU1
VQVSLFNLKI

SEQ ID NO: 956 - protein, 5 aa, Corononavirus-HKU1
TGSGY

SEQ ID NO: 957 - protein, 9 aa, Corononavirus-HKU1
CECPASTLC

SEQ ID NO: 958 - protein, 4 aa, Corononavirus-HKU1
WFIY

SEQ ID NO: 959 - protein, 6 aa, Corononavirus-HKU1
CSIKGI

SEQ ID NO: 960 - protein, 7 aa, Corononavirus-HKU1
SWYRFIL

SEQ ID NO: 961 - protein, 10 aa, Corononavirus-HKU1
SELLPFSAYR

SEQ ID NO: 962 - protein, 7 aa, Corononavirus-HKU1
VLCCQKN

SEQ ID NO: 963 - protein, 4 aa, Corononavirus-HKU1
FRSL

SEQ ID NO: 964 - protein, 5 aa, Corononavirus-HKU1
RENLL

SEQ ID NO: 965 - protein, 6 aa, Corononavirus-HKU1
KLWCCG

SEQ ID NO: 966 - protein, 4 aa, Corononavirus-HKU1
FLYI

SEQ ID NO: 967 - protein, 7 aa, Corononavirus-HKU1
SRATYSS

SEQ ID NO: 968 - protein, 17 aa, Corononavirus-HKU1
ESFKVYYVRSLLCIASF

SEQ ID NO: 969 - protein, 5 aa, Corononavirus-HKU1
LFNIV

SEQ ID NO: 970 - protein, 5 aa, Corononavirus-HKU1
RILLF

SEQ ID NO: 971 - protein, 4 aa, Corononavirus-HKU1
ERLV

SEQ ID NO: 972 - protein, 6 aa, Corononavirus-HKU1
KIRPYF

SEQ ID NO: 973 - protein, 9 aa, Corononavirus-HKU1
YCHFCRHLS

SEQ ID NO: 974 - protein, 10 aa, Corononavirus-HKU1
SRFSWCFNFR

SEQ ID NO: 975 - protein, 8 aa, Corononavirus-HKU1
PRFVWSMV

SEQ ID NO: 976 - protein, 32 aa, Corononavirus-HKU1
FYTNSPRVWCGSCRFLLFLYDAYVDYVSCIRL

SEQ ID NO: 977 - protein, 7 aa, Corononavirus-HKU1
TIRSCTV

SEQ ID NO: 978 - protein, 6 aa, Corononavirus-HKU1
LQVRVV

SEQ ID NO: 979 - protein, 8 aa, Corononavirus-HKU1
VLGYEVSS

SEQ ID NO: 980 - protein, 4 aa, Corononavirus-HKU1
YCGL

SEQ ID NO: 981 - protein, 6 aa, Corononavirus-HKU1
VYYSLC

SEQ ID NO: 982 - protein, 4 aa, Corononavirus-HKU1
YGFT

SEQ ID NO: 983 - protein, 7 aa, Corononavirus-HKU1
YLFWSPC

SEQ ID NO: 984 - protein, 28 aa, Corononavirus-HKU1
TNFCRWCTVCCFYWLPLQRVRCSYELRC

SEQ ID NO: 985 - protein, 8 aa, Corononavirus-HKU1
HTPLSFVS

SEQ ID NO: 986 - protein, 16 aa, Corononavirus-HKU1
RFTSLCSRSCYARCIC

SEQ ID NO: 987 - protein, 6 aa, Corononavirus-HKU1
FTNLLF

SEQ ID NO: 988 - protein, 16 aa, Corononavirus-HKU1
CSCHYKWYKISNCKTR

SEQ ID NO: 989 - protein, 7 aa, Corononavirus-HKU1
PRLLRVC

SEQ ID NO: 990 - protein, 10 aa, Corononavirus-HKU1
FETFFLYSRW

SEQ ID NO: 991 - protein, 4 aa, Corononavirus-HKU1
CCNY

SEQ ID NO: 992 - protein, 5 aa, Corononavirus-HKU1
FTYYG

SEQ ID NO: 993 - protein, 10 aa, Corononavirus-HKU1
AVIVCIRSCL

SEQ ID NO: 994 - protein, 11 aa, Corononavirus-HKU1
WWLYTSITSYC

SEQ ID NO: 995 - protein, 6 aa, Corononavirus-HKU1
KCWLSI

SEQ ID NO: 996 - protein, 5 aa, Corononavirus-HKU1
SQTLL

SEQ ID NO: 997 - protein, 4 aa, Corononavirus-HKU1
GIII

SEQ ID NO: 998 - protein, 5 aa, Corononavirus-HKU1
NLCIY

SEQ ID NO: 999 - protein, 16 aa, Corononavirus-HKU1
CSAHLNSNEFKICYQC

SEQ ID NO: 1000 - protein, 10 aa, Corononavirus-HKU1
SSHCSRCFYS

SEQ ID NO: 1001 - protein, 28 aa, Corononavirus-HKU1
YYDRPNVPSKMFEEYSSYPRCSCCYRNH

SEQ ID NO: 1002 - protein, 16 aa, Corononavirus-HKU1
ILWWLGRYVTSSYKGC

SEQ ID NO: 1003 - protein, 10 aa, Corononavirus-HKU1
QPCSYGLGLS

SEQ ID NO: 1004 - protein, 10 aa, Corononavirus-HKU1
SCYAKYFAYC

SEQ ID NO: 1005 - protein, 7 aa, Corononavirus-HKU1
FSFGPQT

SEQ ID NO: 1006 - protein, 6 aa, Corononavirus-HKU1
ILLFTW

SEQ ID NO: 1007 - protein, 6 aa, Corononavirus-HKU1
ILSPCE

SEQ ID NO: 1008 - protein, 6 aa, Corononavirus-HKU1
MCSSFE

SEQ ID NO: 1009 - protein, 10 aa, Corononavirus-HKU1
NSYVWRLLLC

SEQ ID NO: 1010 - protein, 4 aa, Corononavirus-HKU1
AWWY

SEQ ID NO: 1011 - protein, 6 aa, Corononavirus-HKU1
CNYCFC

SEQ ID NO: 1012 - protein, 7 aa, Corononavirus-HKU1
YMSGCYC

SEQ ID NO: 1013 - protein, 7 aa, Corononavirus-HKU1
CLFSYGL

SEQ ID NO: 1014 - protein, 13 aa, Corononavirus-HKU1
RFKYTQFTKTLIL

SEQ ID NO: 1015 - protein, 7 aa, Corononavirus-HKU1
CLSYRLC

SEQ ID NO: 1016 - protein, 4 aa, Corononavirus-HKU1
LYIC

SEQ ID NO: 1017 - protein, 5 aa, Corononavirus-HKU1
YDDFE

SEQ ID NO: 1018 - protein, 5 aa, Corononavirus-HKU1
WCCLL

SEQ ID NO: 1019 - protein, 4 aa, Corononavirus-HKU1
GLYS

SEQ ID NO: 1020 - protein, 12 aa, Corononavirus-HKU1
YKCFSTSFVLSE

SEQ ID NO: 1021 - protein, 4 aa, Corononavirus-HKU1
CLYV

SEQ ID NO: 1022 - protein, 9 aa, Corononavirus-HKU1
ILFPTYYVS

SEQ ID NO: 1023 - protein, 10 aa, Corononavirus-HKU1
LCLFTISRSF

SEQ ID NO: 1024 - protein, 8 aa, Corononavirus-HKU1
NFRSWLFC

SEQ ID NO: 1025 - protein, 4 aa, Corononavirus-HKU1
FIED

SEQ ID NO: 1026 - protein, 21 aa, Corononavirus-HKU1
QCSFDRALCKSSYRCLPFSTS

SEQ ID NO: 1027 - protein, 17 aa, Corononavirus-HKU1
RIPKSLSCIFRIYKKTV

SEQ ID NO: 1028 - protein, 7 aa, Corononavirus-HKU1
SWYSDLR

SEQ ID NO: 1029 - protein, 6 aa, Corononavirus-HKU1
CYFKYL

SEQ ID NO: 1030 - protein, 5 aa, Corononavirus-HKU1
WFKVY

SEQ ID NO: 1031 - protein, 36 aa, Corononavirus-HKU1
RIILQEYVFKKCRDAECRCMRCLFITNFFALWQLYT

SEQ ID NO: 1032 - protein, 5 aa, Corononavirus-HKU1
AFVML

SEQ ID NO: 1033 - protein, 5 aa, Corononavirus-HKU1
PCYGN

SEQ ID NO: 1034 - protein, 10 aa, Corononavirus-HKU1
ICFECLTLRL

SEQ ID NO: 1035 - protein, 13 aa, Corononavirus-HKU1
CHQIIFGRYVLLL

SEQ ID NO: 1036 - protein, 5 aa, Corononavirus-HKU1
TPLFI

SEQ ID NO: 1037 - protein, 11 aa, Corononavirus-HKU1
VSYEWYGLWFV

SEQ ID NO: 1038 - protein, 10 aa, Corononavirus-HKU1
TILHGFTLYR

SEQ ID NO: 1039 - protein, 4 aa, Corononavirus-HKU1
MDRS

SEQ ID NO: 1040 - protein, 5 aa, Corononavirus-HKU1
LCSGK

SEQ ID NO: 1041 - protein, 13 aa, Corononavirus-HKU1
TFKVICCRNSKGN

SEQ ID NO: 1042 - protein, 12 aa, Corononavirus-HKU1
TKLCFCYHSRDC

SEQ ID NO: 1043 - protein, 9 aa, Corononavirus-HKU1
RSYFVLGDR

SEQ ID NO: 1044 - protein, 10 aa, Corononavirus-HKU1
KLCFHRLPFY

SEQ ID NO: 1045 - protein, 4 aa, Corononavirus-HKU1
DSFR

SEQ ID NO: 1046 - protein, 10 aa, Corononavirus-HKU1
RCVLPRYNYL

SEQ ID NO: 1047 - protein, 4 aa, Corononavirus-HKU1
TFYR

SEQ ID NO: 1048 - protein, 10 aa, Corononavirus-HKU1
CFCFNITFCS

SEQ ID NO: 1049 - protein, 13 aa, Corononavirus-HKU1
FKCTYTCPTRELC

SEQ ID NO: 1050 - protein, 4 aa, Corononavirus-HKU1
YKIF

SEQ ID NO: 1051 - protein, 7 aa, Corononavirus-HKU1
CSIGVSK

SEQ ID NO: 1052 - protein, 41 aa, Corononavirus-HKU1
LSAHWNETLLHCSRSPWYGKVSSCYRSSCLLLHSTCSLYCC

SEQ ID NO: 1053 - protein, 8 aa, Corononavirus-HKU1
SCCCRCIV

SEQ ID NO: 1054 - protein, 4 aa, Corononavirus-HKU1
VFKY

SEQ ID NO: 1055 - protein, 8 aa, Corononavirus-HKU1
RLYTYYSC

SEQ ID NO: 1056 - protein, 6 aa, Corononavirus-HKU1
SSCRLL

SEQ ID NO: 1057 - protein, 19 aa, Corononavirus-HKU1
VCFYHNKCITRVGYRYCCC

SEQ ID NO: 1058 - protein, 8 aa, Corononavirus-HKU1
IVCYKCSY

SEQ ID NO: 1059 - protein, 25 aa, Corononavirus-HKU1
TLCIYWRSCSITCTTCAVEQGFFRT

SEQ ID NO: 1060 - protein, 6 aa, Corononavirus-HKU1
ALQFYY

SEQ ID NO: 1061 - protein, 7 aa, Corononavirus-HKU1
NNVLFRS

SEQ ID NO: 1062 - protein, 7 aa, Corononavirus-HKU1
YLFGKLL

SEQ ID NO: 1063 - protein, 11 aa, Corononavirus-HKU1
RNCRNCFSIGL

SEQ ID NO: 1064 - protein, 4 aa, Corononavirus-HKU1
FIMF

SEQ ID NO: 1065 - protein, 5 aa, Corononavirus-HKU1
GTDNT

SEQ ID NO: 1066 - protein, 13 aa, Corononavirus-HKU1
EFKCCKYSTDISN

SEQ ID NO: 1067 - protein, 4 aa, Corononavirus-HKU1
IFKS

SEQ ID NO: 1068 - protein, 4 aa, Corononavirus-HKU1
SSLE

SEQ ID NO: 1069 - protein, 4 aa, Corononavirus-HKU1
CCFY

SEQ ID NO: 1070 - protein, 5 aa, Corononavirus-HKU1
SELCC

SEQ ID NO: 1071 - protein, 18 aa, Corononavirus-HKU1
ACFRCSNTNCRFCSRFGI

SEQ ID NO: 1072 - protein, 14 aa, Corononavirus-HKU1
LCYIFTNSRNSPFC

SEQ ID NO: 1073 - protein, 4 aa, Corononavirus-HKU1
CCHN

SEQ ID NO: 1074 - protein, 10 aa, Corononavirus-HKU1
SQEGHFLCYE

SEQ ID NO: 1075 - protein, 4 aa, Corononavirus-HKU1
YAII

SEQ ID NO: 1076 - protein, 7 aa, Corononavirus-HKU1
FYYSTFR

SEQ ID NO: 1077 - protein, 13 aa, Corononavirus-HKU1
NSKSNFTSFALHN

SEQ ID NO: 1078 - protein, 16 aa, Corononavirus-HKU1
KLLRLSSSACPLIFSS

SEQ ID NO: 1079 - protein, 9 aa, Corononavirus-HKU1
KFGCKFKYL

SEQ ID NO: 1080 - protein, 14 aa, Corononavirus-HKU1
TCFNIFSFNISYGF

SEQ ID NO: 1081 - protein, 5 aa, Corononavirus-HKU1
IRFDS

SEQ ID NO: 1082 - protein, 4 aa, Corononavirus-HKU1
IVYY

SEQ ID NO: 1083 - protein, 5 aa, Corononavirus-HKU1
RLGWF

SEQ ID NO: 1084 - protein, 27 aa, Corononavirus-HKU1
GRSCYSRKHWNKLSTANRFFNWCGFCS

SEQ ID NO: 1085 - protein, 6 aa, Corononavirus-HKU1
SYWLIC

SEQ ID NO: 1086 - protein, 6 aa, Corononavirus-HKU1
ERLLYF

SEQ ID NO: 1087 - protein, 4 aa, Corononavirus-HKU1
KNCS

SEQ ID NO: 1088 - protein, 4 aa, Corononavirus-HKU1
SSSW

SEQ ID NO: 1089 - protein, 15 aa, Corononavirus-HKU1
TFNTPYVKRSKVGYC

SEQ ID NO: 1090 - protein, 6 aa, Corononavirus-HKU1
NCSNVI

SEQ ID NO: 1091 - protein, 6 aa, Corononavirus-HKU1
LSFRPF

SEQ ID NO: 1092 - protein, 10 aa, Corononavirus-HKU1
CSIYYLVCQF

SEQ ID NO: 1093 - protein, 8 aa, Corononavirus-HKU1
TYLFKVFC

SEQ ID NO: 1094 - protein, 5 aa, Corononavirus-HKU1
IRQRA

SEQ ID NO: 1095 - protein, 7 aa, Corononavirus-HKU1
SCYMLQF

SEQ ID NO: 1096 - protein, 9 aa, Corononavirus-HKU1
NWLLWLLAP

SEQ ID NO: 1097 - protein, 16 aa, Corononavirus-HKU1
STYCRYTTVGLYRFFN

SEQ ID NO: 1098 - protein, 5 aa, Corononavirus-HKU1
SRYNL

SEQ ID NO: 1099 - protein, 7 aa, Corononavirus-HKU1
RCTCCVS

SEQ ID NO: 1100 - protein, 10 aa, Corononavirus-HKU1
CNYDSLFSNL

SEQ ID NO: 1101 - protein, 9 aa, Corononavirus-HKU1
LEFRVSNNF

SEQ ID NO: 1102 - protein, 7 aa, Corononavirus-HKU1
GQYKYIL

SEQ ID NO: 1103 - protein, 7 aa, Corononavirus-HKU1
VIAACHA

SEQ ID NO: 1104 - protein, 5 aa, Corononavirus-HKU1
SCHAM

SEQ ID NO: 1105 - protein, 5 aa, Corononavirus-HKU1
IQLML

SEQ ID NO: 1106 - protein, 4 aa, Corononavirus-HKU1
HRQS

SEQ ID NO: 1107 - protein, 8 aa, Corononavirus-HKU1
RFSLCQRL

SEQ ID NO: 1108 - protein, 8 aa, Corononavirus-HKU1
CFSCSQVC

SEQ ID NO: 1109 - protein, 6 aa, Corononavirus-HKU1
TVILCL

SEQ ID NO: 1110 - protein, 9 aa, Corononavirus-HKU1
RWFMYVLEL

SEQ ID NO: 1111 - protein, 4 aa, Corononavirus-HKU1
FNCL

SEQ ID NO: 1112 - protein, 5 aa, Corononavirus-HKU1
HSSVK

SEQ ID NO: 1113 - protein, 6 aa, Corononavirus-HKU1
IKPSWM

SEQ ID NO: 1114 - protein, 5 aa, Corononavirus-HKU1
TCIPY

SEQ ID NO: 1115 - protein, 20 aa, Corononavirus-HKU1
AYAFFLLFRYALCVRRWFRI

SEQ ID NO: 1116 - protein, 13 aa, Corononavirus-HKU1
LRSFKKRHLYHTV

SEQ ID NO: 1117 - protein, 10 aa, Corononavirus-HKU1
SRWSCLFKAC

SEQ ID NO: 1118 - protein, 12 aa, Corononavirus-HKU1
YSYYSRLYFLGL

SEQ ID NO: 1119 - protein, 16 aa, Corononavirus-HKU1
FMEHFYYVTEFRKRNI

SEQ ID NO: 1120 - protein, 4 aa, Corononavirus-HKU1
CWSL

SEQ ID NO: 1121 - protein, 4 aa, Corononavirus-HKU1
WTYR

SEQ ID NO: 1122 - protein, 7 aa, Corononavirus-HKU1
ITLCYYE

SEQ ID NO: 1123 - protein, 4 aa, Corononavirus-HKU1
QSCC

SEQ ID NO: 1124 - protein, 6 aa, Corononavirus-HKU1
CRYCYF

SEQ ID NO: 1125 - protein, 5 aa, Corononavirus-HKU1
YIISY

SEQ ID NO: 1126 - protein, 5 aa, Corononavirus-HKU1
IVYKT

SEQ ID NO: 1127 - protein, 5 aa, Corononavirus-HKU1
YPAPP

SEQ ID NO: 1128 - protein, 4 aa, Corononavirus-HKU1
KFEH

SEQ ID NO: 1129 - protein, 11 aa, Corononavirus-HKU1
YLLEACPVGLC

SEQ ID NO: 1130 - protein, 6 aa, Corononavirus-HKU1
FHLWCL

SEQ ID NO: 1131 - protein, 14 aa, Corononavirus-HKU1
IHRFEVHRKFEYTF

SEQ ID NO: 1132 - protein, 7 aa, Corononavirus-HKU1
HWRFRSF

SEQ ID NO: 1133 - protein, 8 aa, Corononavirus-HKU1
KSKKWCFY

SEQ ID NO: 1134 - protein, 4 aa, Corononavirus-HKU1
VIND

SEQ ID NO: 1135 - protein, 5 aa, Corononavirus-HKU1
RSATS

SEQ ID NO: 1136 - protein, 7 aa, Corononavirus-HKU1
FKWCDCG

SEQ ID NO: 1137 - protein, 6 aa, Corononavirus-HKU1
SWRTQS

SEQ ID NO: 1138 - protein, 9 aa, Corononavirus-HKU1
VLVRYEKRW

SEQ ID NO: 1139 - protein, 20 aa, Corononavirus-HKU1
RCYLQPNRQPMLKPLLEPTR

SEQ ID NO: 1140 - protein, 17 aa, Corononavirus-HKU1
CSNTFYYLYSESCIVKF

SEQ ID NO: 1141 - protein, 10 aa, Corononavirus-HKU1
TSLRFRTGFY

SEQ ID NO: 1142 - protein, 4 aa, Corononavirus-HKU1
SVYC

SEQ ID NO: 1143 - protein, 8 aa, Corononavirus-HKU1
IWFRRLCI

SEQ ID NO: 1144 - protein, 5 aa, Corononavirus-HKU1
SYSLW

SEQ ID NO: 1145 - protein, 13 aa, Corononavirus-HKU1
SYRRFAFAYRLIS

SEQ ID NO: 1146 - protein, 4 aa, Corononavirus-HKU1
EKKI

SEQ ID NO: 1147 - protein, 9 aa, Corononavirus-HKU1
FVNSRVFTV

SEQ ID NO: 1148 - protein, 7 aa, Corononavirus-HKU1
YSFIFYY

SEQ ID NO: 1149 - protein, 4 aa, Corononavirus-HKU1
SGVW

SEQ ID NO: 1150 - protein, 6 aa, Corononavirus-HKU1
ECLYSY

SEQ ID NO: 1151 - protein, 4 aa, Corononavirus-HKU1
FIIR

SEQ ID NO: 1152 - protein, 5 aa, Corononavirus-HKU1
FCFYC

SEQ ID NO: 1153 - protein, 7 aa, Corononavirus-HKU1
VIKFELC

SEQ ID NO: 1154 - protein, 8 aa, Corononavirus-HKU1
GFSIYVVV

SEQ ID NO: 1155 - protein, 6 aa, Corononavirus-HKU1
NYDFLS

SEQ ID NO: 1156 - protein, 4 aa, Corononavirus-HKU1
NASH

SEQ ID NO: 1157 - protein, 11 aa, Corononavirus-HKU1
LETWLFYACFV

SEQ ID NO: 1158 - protein, 15 aa, Corononavirus-HKU1
VFECSIRESLFMELW

SEQ ID NO: 1159 - protein, 10 aa, Corononavirus-HKU1
FAYRLYDECC

SEQ ID NO: 1160 - protein, 17 aa, Corononavirus-HKU1
VHSIMSVFEYYNISCSC

SEQ ID NO: 1161 - protein, 10 aa, Corononavirus-HKU1
YACFTFRCRV

SEQ ID NO: 1162 - protein, 16 aa, Corononavirus-HKU1
RSSSRFCCFKTVVTIW

SEQ ID NO: 1163 - protein, 4 aa, Corononavirus-HKU1
YSCR

SEQ ID NO: 1164 - protein, 5 aa, Corononavirus-HKU1
FKPIC

SEQ ID NO: 1165 - protein, 13 aa, Corononavirus-HKU1
FSYLFWRLYDFTI

SEQ ID NO: 1166 - protein, 8 aa, Corononavirus-HKU1
LSLGFDNI

SEQ ID NO: 1167 - protein, 12 aa, Corononavirus-HKU1
GWVFYLHLSFNS

SEQ ID NO: 1168 - protein, 5 aa, Corononavirus-HKU1
IIFGW

SEQ ID NO: 1169 - protein, 12 aa, Corononavirus-HKU1
CSYKNYRVFLEC

SEQ ID NO: 1170 - protein, 13 aa, Corononavirus-HKU1
INELFCILDSFLY

SEQ ID NO: 1171 - protein, 5 aa, Corononavirus-HKU1
CKCFF

SEQ ID NO: 1172 - protein, 10 aa, Corononavirus-HKU1
RVFNRYKLPG

SEQ ID NO: 1173 - protein, 8 aa, Corononavirus-HKU1
NRWQCYAC

SEQ ID NO: 1174 - protein, 6 aa, Corononavirus-HKU1
LFVLEK

SEQ ID NO: 1175 - protein, 8 aa, Corononavirus-HKU1
YNMEWRCL

SEQ ID NO: 1176 - protein, 11 aa, Corononavirus-HKU1
IFFEIGWHCCC

SEQ ID NO: 1177 - protein, 7 aa, Corononavirus-HKU1
FKTRSIK

SEQ ID NO: 1178 - protein, 6 aa, Corononavirus-HKU1
FSLFSY

SEQ ID NO: 1179 - protein, 7 aa, Corononavirus-HKU1
IISSRYA

SEQ ID NO: 1180 - protein, 5 aa, Corononavirus-HKU1
RDFCW

SEQ ID NO: 1181 - protein, 14 aa, Corononavirus-HKU1
SCKYLLDLIKSKLC

SEQ ID NO: 1182 - protein, 21 aa, Corononavirus-HKU1
LFFYFFISVMVLMNLLMLCLI

SEQ ID NO: 1183 - protein, 19 aa, Corononavirus-HKU1
TMTGFYLVIVVLIVTILII

SEQ ID NO: 1184 - protein, 76 aa, Corononavirus-HKU1
KLKILIIWIFTLVCATMVRFHLVPVILFLRVFISLDFIITLAKVIKLFFMRVLILILIIDLSVFLMVVMMYGFLTR

SEQ ID NO: 1185 - protein, 56 aa, Corononavirus-HKU1
DFIVPYILIWPFFVILLLLIFLIMFLFLSLILVKVIFYHLTILFLLIILRKFILLY

SEQ ID NO: 1186 - protein, 5 aa, Corononavirus-HKU1
VVLFI

SEQ ID NO: 1187 - protein, 16 aa, Corononavirus-HKU1
YRFAFLNLTLVSTIIT

SEQ ID NO: 1188 - protein, 15 aa, Corononavirus-HKU1
ILALFMVFLMLFILI

SEQ ID NO: 1189 - protein, 150 aa, Corononavirus-HKU1
TVFIFLLNQVLIKFPPLHLFYPYLLKLSVLINLNNLYLYRLLILDGTTSVPQIFLYLLHVNCHIVIFAILLLIMLASMILTTVIVVLFLFYLVFYIMFLVFHIMVYFYMIILHPFGPIILLVGVLHLLLLNIQFVFMIFCLLFYKVFYYV

SEQ ID NO: 1190 - protein, 37 aa, Corononavirus-HKU1
LYFLLFFYYFCYITINLIKSKHVINYFYFAYNISCYR

SEQ ID NO: 1191 - protein, 9 aa, Corononavirus-HKU1
FKHHSSSHK

SEQ ID NO: 1192 - protein, 15 aa, Corononavirus-HKU1
VCCGCFLWFGYILYT

SEQ ID NO: 1193 - protein, 15 aa, Corononavirus-HKU1
SCLFKYYYIIYWLFP

SEQ ID NO: 1194 - protein, 5 aa, Corononavirus-HKU1
IWCQF

SEQ ID NO: 1195 - protein, 21 aa, Corononavirus-HKU1
GSIFKRYYIFEYSLVSETLFI

SEQ ID NO: 1196 - protein, 4 aa, Corononavirus-HKU1
WYFF

SEQ ID NO: 1197 - protein, 5 aa, Corononavirus-HKU1
YYSYR

SEQ ID NO: 1198 - protein, 10 aa, Corononavirus-HKU1
QLLYYCCSTS

SEQ ID NO: 1199 - protein, 13 aa, Corononavirus-HKU1
WCFGDYSLSIHYV

SEQ ID NO: 1200 - protein, 6 aa, Corononavirus-HKU1
VSSYYL

SEQ ID NO: 1201 - protein, 4 aa, Corononavirus-HKU1
ILAF

SEQ ID NO: 1202 - protein, 11 aa, Corononavirus-HKU1
TFVSVQEKFYL

SEQ ID NO: 1203 - protein, 22 aa, Corononavirus-HKU1
CFYRLVVFSFLSRTWHFLCLLC

SEQ ID NO: 1204 - protein, 9 aa, Corononavirus-HKU1
FWHAYYFFI

SEQ ID NO: 1205 - protein, 17 aa, Corononavirus-HKU1
FVSWYSFISLLCFAFDL

SEQ ID NO: 1206 - protein, 4 aa, Corononavirus-HKU1
CYIF

SEQ ID NO: 1207 - protein, 10 aa, Corononavirus-HKU1
DFTILGHTFV

SEQ ID NO: 1208 - protein, 5 aa, Corononavirus-HKU1
TPISS

SEQ ID NO: 1209 - protein, 6 aa, Corononavirus-HKU1
QPWCYY

SEQ ID NO: 1210 - protein, 4 aa, Corononavirus-HKU1
RDSM

SEQ ID NO: 1211 - protein, 4 aa, Corononavirus-HKU1
IFIT

SEQ ID NO: 1212 - protein, 4 aa, Corononavirus-HKU1
YWCL

SEQ ID NO: 1213 - protein, 6 aa, Corononavirus-HKU1
LIWFYC

SEQ ID NO: 1214 - protein, 10 aa, Corononavirus-HKU1
ACCNCTSSYS

SEQ ID NO: 1215 - protein, 5 aa, Corononavirus-HKU1
CTLTS

SEQ ID NO: 1216 - protein, 10 aa, Corononavirus-HKU1
FEYFASFSSY

SEQ ID NO: 1217 - protein, 4 aa, Corononavirus-HKU1
FFFL

SEQ ID NO: 1218 - protein, 5 aa, Corononavirus-HKU1
EYCFR

SEQ ID NO: 1219 - protein, 9 aa, Corononavirus-HKU1
ICHTQLQTI

SEQ ID NO: 1220 - protein, 12 aa, Corononavirus-HKU1
FAVGQFWFSAIF

SEQ ID NO: 1221 - protein, 6 aa, Corononavirus-HKU1
FLSIVL

SEQ ID NO: 1222 - protein, 4 aa, Corononavirus-HKU1
FACN

SEQ ID NO: 1223 - protein, 5 aa, Corononavirus-HKU1
SFFLE

SEQ ID NO: 1224 - protein, 4 aa, Corononavirus-HKU1
KVWF

SEQ ID NO: 1225 - protein, 4 aa, Corononavirus-HKU1
FELS

SEQ ID NO: 1226 - protein, 10 aa, Corononavirus-HKU1
CCLLTLLFFC

SEQ ID NO: 1227 - protein, 6 aa, Corononavirus-HKU1
YFLSLC

SEQ ID NO: 1228 - protein, 10 aa, Corononavirus-HKU1
TFFCFKLQES

SEQ ID NO: 1229 - protein, 10 aa, Corononavirus-HKU1
TTFCFLSYWY

SEQ ID NO: 1230 - protein, 4 aa, Corononavirus-HKU1
LSFL

SEQ ID NO: 1231 - protein, 8 aa, Corononavirus-HKU1
EYYCTRPH

SEQ ID NO: 1232 - protein, 5 aa, Corononavirus-HKU1
VFLFT

SEQ ID NO: 1233 - protein, 5 aa, Corononavirus-HKU1
SYNCL

SEQ ID NO: 1234 - protein, 12 aa, Corononavirus-HKU1
VLFSKKVSGWCW

SEQ ID NO: 1235 - protein, 7 aa, Corononavirus-HKU1
TLCRVRC

SEQ ID NO: 1236 - protein, 10 aa, Corononavirus-HKU1
RKVWCIGWII

SEQ ID NO: 1237 - protein, 5 aa, Corononavirus-HKU1
CFLSL

SEQ ID NO: 1238 - protein, 7 aa, Corononavirus-HKU1
CLSRLVL

SEQ ID NO: 1239 - protein, 4 aa, Corononavirus-HKU1
HLRQ

SEQ ID NO: 1240 - protein, 7 aa, Corononavirus-HKU1
FYFKWYQ

SEQ ID NO: 1241 - protein, 5 aa, Corononavirus-HKU1
WYHLF

SEQ ID NO: 1242 - protein, 4 aa, Corononavirus-HKU1
FIAA

SEQ ID NO: 1243 - protein, 12 aa, Corononavirus-HKU1
LRPLWYYRTRYF

SEQ ID NO: 1244 - protein, 7 aa, Corononavirus-HKU1
RSFCCLL

SEQ ID NO: 1245 - protein, 6 aa, Corononavirus-HKU1
LAKSFV

SEQ ID NO: 1246 - protein, 6 aa, Corononavirus-HKU1
WQHYWF

SEQ ID NO: 1247 - protein, 4 aa, Corononavirus-HKU1
RFCY

SEQ ID NO: 1248 - protein, 25 aa, Corononavirus-HKU1
YFPLLCRKSFCCFSSKCFLFGFTLS

SEQ ID NO: 1249 - protein, 4 aa, Corononavirus-HKU1
LCFE

SEQ ID NO: 1250 - protein, 9 aa, Corononavirus-HKU1
YFFNYSAIF

SEQ ID NO: 1251 - protein, 6 aa, Corononavirus-HKU1
LSWLRF

SEQ ID NO: 1252 - protein, 11 aa, Corononavirus-HKU1
LFCFFLCSSHG

SEQ ID NO: 1253 - protein, 4 aa, Corononavirus-HKU1
WFLC

SEQ ID NO: 1254 - protein, 9 aa, Corononavirus-HKU1
LTFFFLFAS

SEQ ID NO: 1255 - protein, 11 aa, Corononavirus-HKU1
KYFCFLSFCYF

SEQ ID NO: 1256 - protein, 4 aa, Corononavirus-HKU1
CQFC

SEQ ID NO: 1257 - protein, 6 aa, Corononavirus-HKU1
VCGWSL

SEQ ID NO: 1258 - protein, 5 aa, Corononavirus-HKU1
DQNSH

SEQ ID NO: 1259 - protein, 12 aa, Corononavirus-HKU1
LYYSWSRGIYSN

SEQ ID NO: 1260 - protein, 7 aa, Corononavirus-HKU1
LFFICLF

SEQ ID NO: 1261 - protein, 5 aa, Corononavirus-HKU1
LCSLP

SEQ ID NO: 1262 - protein, 9 aa, Corononavirus-HKU1
LIVRVWHFL

SEQ ID NO: 1263 - protein, 7 aa, Corononavirus-HKU1
YYSIACS

SEQ ID NO: 1264 - protein, 8 aa, Corononavirus-HKU1
YSYARCHT

SEQ ID NO: 1265 - protein, 18 aa, Corononavirus-HKU1
IPSWMFRSTLRFFFSFFF

SEQ ID NO: 1266 - protein, 4 aa, Corononavirus-HKU1
RFIV

SEQ ID NO: 1267 - protein, 7 aa, Corononavirus-HKU1
TFRCWFC

SEQ ID NO: 1268 - protein, 5 aa, Corononavirus-HKU1
QLYWW

SEQ ID NO: 1269 - protein, 8 aa, Corononavirus-HKU1
RSSLCTIL

SEQ ID NO: 1270 - protein, 7 aa, Corononavirus-HKU1
SFASYFV

SEQ ID NO: 1271 - protein, 29 aa, Corononavirus-HKU1
ISNFWLHHSRYCCCYVSTMVSSSWHTIFS

SEQ ID NO: 1272 - protein, 9 aa, Corononavirus-HKU1
WFGCYYGCS

SEQ ID NO: 1273 - protein, 9 aa, Corononavirus-HKU1
KSKVDSYCF

SEQ ID NO: 1274 - protein, 9 aa, Corononavirus-HKU1
CSSFYSEWF

SEQ ID NO: 1275 - protein, 7 aa, Corononavirus-HKU1
CYQLCTC

SEQ ID NO: 1276 - protein, 5 aa, Corononavirus-HKU1
NTKCC

SEQ ID NO: 1277 - protein, 4 aa, Corononavirus-HKU1
CSST

SEQ ID NO: 1278 - protein, 6 aa, Corononavirus-HKU1
FVTAII

SEQ ID NO: 1279 - protein, 4 aa, Corononavirus-HKU1
IWCN

SEQ ID NO: 1280 - protein, 19 aa, Corononavirus-HKU1
FFFTRNFISSRCFRGSGSD

SEQ ID NO: 1281 - protein, 14 aa, Corononavirus-HKU1
WSFNCFKCLCLSTA

SEQ ID NO: 1282 - protein, 15 aa, Corononavirus-HKU1
YFSCKIWCCFSYGEG

SEQ ID NO: 1283 - protein, 6 aa, Corononavirus-HKU1
KSISSY

SEQ ID NO: 1284 - protein, 18 aa, Corononavirus-HKU1
SYFVISSKCSLWFVVYAF

SEQ ID NO: 1285 - protein, 4 aa, Corononavirus-HKU1
TYFF

SEQ ID NO: 1286 - protein, 12 aa, Corononavirus-HKU1
NCFSKSWFVYIR

SEQ ID NO: 1287 - protein, 5 aa, Corononavirus-HKU1
CRYCT

SEQ ID NO: 1288 - protein, 5 aa, Corononavirus-HKU1
TRVFY

SEQ ID NO: 1289 - protein, 6 aa, Corononavirus-HKU1
SLDVHW

SEQ ID NO: 1290 - protein, 5 aa, Corononavirus-HKU1
FLLLS

SEQ ID NO: 1291 - protein, 4 aa, Corononavirus-HKU1
TNFR

SEQ ID NO: 1292 - protein, 10 aa, Corononavirus-HKU1
KCCFYEYLFC

SEQ ID NO: 1293 - protein, 14 aa, Corononavirus-HKU1
SASCLFESFCTKIV

SEQ ID NO: 1294 - protein, 5 aa, Corononavirus-HKU1
VISLV

SEQ ID NO: 1295 - protein, 7 aa, Corononavirus-HKU1
KSNIHCA

SEQ ID NO: 1296 - protein, 8 aa, Corononavirus-HKU1
FDFKSSYY

SEQ ID NO: 1297 - protein, 8 aa, Corononavirus-HKU1
CYFFRFVL

SEQ ID NO: 1298 - protein, 8 aa, Corononavirus-HKU1
DESYSRVY

SEQ ID NO: 1299 - protein, 4 aa, Corononavirus-HKU1
LYQS

SEQ ID NO: 1300 - protein, 5 aa, Corononavirus-HKU1
RYRYI

SEQ ID NO: 1301 - protein, 38 aa, Corononavirus-HKU1
NVCKMALVCLATNFFFIYNIPCIALFYMLLYWLWFCMF

SEQ ID NO: 1302 - protein, 5 aa, Corononavirus-HKU1
VWWSS

SEQ ID NO: 1303 - protein, 7 aa, Corononavirus-HKU1
FCYQNIS

SEQ ID NO: 1304 - protein, 8 aa, Corononavirus-HKU1
LESLVRSH

SEQ ID NO: 1305 - protein, 112 aa, Corononavirus-HKU1
TLFMDVWRPSYTHSLVIREFGVTNLEDLCLKYNYCQPIVGYCIVPLNVWCRKFGKFASHFTLRSHDISHSNNFGVVTSFTTYGNTVSEAVSRLVESASEFIVWRAEALNKYG

SEQ ID NO: 1306 - protein, 4 aa, Corononavirus-HKU1
FIFQ

SEQ ID NO: 1307 - protein, 29 aa, Corononavirus-HKU1
YCLVHRTDFSFSFILSYFFNLCCCFFSNY

SEQ ID NO: 1308 - protein, 9 aa, Corononavirus-HKU1
ALYATLWFL

SEQ ID NO: 1309 - protein, 11 aa, Corononavirus-HKU1
FLYYFTFGLRL

SEQ ID NO: 1310 - protein, 6 aa, Corononavirus-HKU1
KRYAVV

SEQ ID NO: 1311 - protein, 239 aa, Corononavirus-HKU1
TSYTTHFRLFNLNLNIMNKSFLPQFTSDQAVTFLKEWNFSLGVILLFITIILQFGYTSRSMFVYLIKMIILWLMWPLTITLTIFNCFYALNNAFLAFSIVFTIISIVIWILYFVNSIRLFIRTGSWWSFNPETNNLMCIDMKGKMFVRPVIEDYHTLTATVIRGHLYIQGVKLGTGYTLSDLPVYVTVAKVQVLCTYKRAFLDKLDVNSGFAVFVKSKVGNYRLPSSKPSGMDTALLRA

SEQ ID NO: 1312 - protein, 444 aa, Corononavirus-HKU1
TIRMSYTPGHYAGSRSSSGNRSGILKKTSWADQSERNYQTFNRGRKTQPKFTVSTQPQGNTIPHYSWFSGITQFQKGRDFKFSDGQGVPIAFGVPPSEAKGYWYRHSRRSFKTADGQQKQLLPRWYFYYLGTGPYANASYGESLEGVFWVANHQADTSTPSDVSSRDPTTQEAIPTRFPPGTILPQGYYVEGSGRSASNSRPGSRSQSRGPNNRSLSRSNSNFRHSDSIVKPDMADEIANLVLAKLGKDSKPQQVTKQNAKEIRHKILTKPRQKRTPNKHCNVQQCFGKRGPSQNFGNAEMLKLGTNDPQFPILAELAPTPGAFFFGSKLDLVKRDSEADSPVKDVFELHYSGSIRFDSTLPGFETIMKVLEENLNAYVNSNQNTDSDSLSSKPQRKRGVKQLPEQFDSLNLSAGTQHISNDFTPEDHSLLATLDDPYVEDSVA

SEQ ID NO: 1313 - protein, 5 aa, Corononavirus-HKU1
ILIRH

SEQ ID NO: 1314 - protein, 9 aa, Corononavirus-HKU1
VVTPRYYSE

SEQ ID NO: 1315 - protein, 10 aa, Corononavirus-HKU1
DTLYQNEFLL

SEQ ID NO: 1316 - protein, 38 aa, Corononavirus-HKU1
VVTDYILISRNFIFRHLIVRVVIRFSCSINASGKSYQL

SEQ ID NO: 1317 - protein, 9 aa, Corononavirus-HKU1
CLIYILVYD

SEQ ID NO: 1318 - protein, 11 aa, Corononavirus-HKU1
PFGGITKKKKK

SEQ ID NO: 1319 - DNA, 29942 bp, Corononavirus-HKU1
  CDS (1)..(29940)
ttttttttttttttttgtaattcctccaaaaggctataattaatttcaatcatatactaatatatatattaaacactacaattgatagctcttcccggaggcgtttatactacagctaaaccttataactactctaacaatcaaatgtctaaatataaaatttctactaattaatatatagtctgtaacaacctactctatctgttattacagcaagaattcattctgatagagagtgtcctattccgaataatagcgaggggttaccacctagtgtcgaattaggattcattctcattaagcaacagagtcttctacataaggatcatcaagagtagcaagtaaactatgatcctcaggagtaaaatcatttgaaatgtgctgagtaccagcacttaaattaagagagtcaaactgttctggtaattgtttaacacctcttttacgctgaggtttagaactcaacgaatcagaatcagtgttctgattagaattaacgtaagcatttaaattctcttcaagaactttcataattgtctcaaagcctggtaaagtactatcaaacctaatagaaccagaataatgaagttcaaaaacatctttaacaggtgagtcagcctcggaatctcttttaaccaagtctaatttagaaccaaagaaaaaagcacctggtgtaggagctaattctgcaagaataggaaactgaggatcattagtaccaagctttaacatttcagcattaccaaaattttgagaaggtcctcttttaccaaaacactgttgaacattacaatgtttattaggagttcgcttttggcgaggttttgttaaaattttatgcctgatttccttggcattttgcttagtgacttgctgaggtttagaatctttaccaagcttggctaaaacaagattagcgatctcatcagccatatcaggttttactatagaatctgaatgtctaaaattagaattacttctacttaatgaacgattattgggtccacgtgattgagaacgtgaacctggtcgactattagaagcagaccttcctgagccttcaacataatagccttgaggcaaaatcgtaccaggcggaaacctagtagggatagcttcttgagtagtaggatcccttgacgaaacatcggagggagtagaagtgtcagcttggtgattagcaacccagaagaccccttcgagggattcaccataggatgcattggcatatgggccggtaccgagatagtagaaataccatctcggtaacaactgcttttgttgaccatcagctgttttaaaagaacgccggctgtgtctataccaatatccttttgcttcagaagggggtactccgaaagcaatgggaactccttgaccatctgaaaatttaaagtctctacctttttgaaattgagtgatcccggagaaccaggaataatgtgggatagtatttccttgtggttgagtagacacagtgaatttaggttgggtttttctgcctctattaaaggtttggtaatttcgctcagattggtcagcccaagaagttttcttgaggattcctgaacgatttccagaggagcttctacttccagcataatgaccgggagtataagacatcctaatagtttagatttaagctcttaacaaggcagtatccataccactaggtttactagacggtaaacgatagttaccaactttagacttaacaaaaacagcaaaaccactattaacatctaacttatctaaaaaggcacgtttataggtacaaagtacttgcaccttagctacagtaacatatacgggcaaatctgaaagagtataaccagtgccaagtttgacaccctgtatataaagatgaccacgaataacagtagcagttaatgtgtgatagtcctcaataactggcctaacaaacatcttgcctttcatatcaatacacataagattattggtctctggattaaaactccaccaactgccagttctaataaaaagccgaatactattaacaaaataaagaatccatataacaatagaaataatagtaaacactatagaaaatgcaagaaaagcattattcaaagcataaaaacaattaaatatagtcaaggtgatagtcaatggccacataagccaaagaataatcatcttgataagataaacaaacatactacggctcgtataaccgaactgcaatatgatagtaataaaaagtagtattacacccaaagagaaattccattcttttaagaatgtaacagcttgatcagaagtaaattgaggaagaaaagatttattcataatgtttagatttagattaaataatctgaagtgggtggtataacttgttcactataagacttatacaactgcatacctcttttataaacgtaagccgaaggtgaaataataaagaaattacaaaaaccacaaagttgcatacaaagcttaatagttgctaaaaaagcaacaacaaagattaaagaaataagacaaaataaaactaaaactaaaatctgtcctatgtaccaagcagtatcattgaaaaataaatcaaccatacttattaagtgcctctgcacgccaaacaataaattcagaagctgattcaactaatctagacacagcctcagaaacagtattaccataagtagtaaaactagttacaacaccaaaattattactatgggaaatatcgtgactacgtaatgtaaagtgagaagcaaatttgccaaacttgcgacaccaaacatttaaaggtacaatacagtaaccaacaataggttgacagtaattatactttagacacaaatcttcaaggtttgtaacaccaaattctctaataacaagagaatgtgtgtagctaggtctccaaacgtccataaataaagtttagatttaatgagatctgacaagagattctaatcatcatgagatgttttgataacaaaatcatgatgaccaccatactcatcacaacaattatgacatttactaaaacatgcagaaccacaaccagtacaacaacatataaaaaagagcaatacaaggaatattataaatgaaaaagaaattagtagccaaacataccaaggccattttacatacatttcatatgtacctatatctttaagattgatataactattattcaaagacttaatagactcttgaataagattcatctcataatacaaatctaaaaaagtagcattaatagtatgaagatttaaagtcaaattaggcgcaatggatgtttgatttttaaaccaatgagataactcagattcaaaatcagacaattttggtacagaatgattcaaataaacaagaggcgctttagtaaaattaacagaacaagtattcataaaaacaacatttttatctgaaattggttcaggataatagtaagaactaccagtgaacatccaatgatcattatgtttaataaaatacccttgtttaggtgcaatacctacatcacctgatatacacaaaccaggacttactaaaacagttttaaaagaaataggtttataactaaaatgcataaacaacaaaccataaggagcattttgaactaatgacaaaatatgattaccattaccacaaaaattaatacgaggagattgacttttaacacactcattaaccttctccatagctaaagcagcaccaaattttacaagagaaatatcactaagctgttgagagacataagcatttaaagcagttaaacgaccattaataagcctatcaatctgaacctgagcctctaaagcatcgagacgagataaaatttcttgtaaagaagaactaattgcaccaaatttattaaataattgctgtaacaaactattaagtgcttgagcattagaattaacaacactttgtattttagcaagtgcagagttggtagcactaaaaccattctgaatagaaagaagagcattattaaaagcagtagctatcaacttttgatttttattaagaacatccatagtaacacccaaaccattaattctatattgtacattaagagaaaatggtatgccagctgctgctgaccatggtggaaacatagcagcaacagtagcggctgtggtgtaaccagaaatttgagattcagacaaaataggaggcaaaactttaataccattaaaggattgtacacaaagaagatctctaatttcactaccaccagtacaattgttataagcttcaacaaaaccaacatctgaaagtttaactttgtcaaacaataaatcttcaaaaaaagaacgagaagaagaaccgcagtgtggacctaaacatccaactagggatttaaaattaatattatcaacatcaaaatgcaaattagtattaagattggagctaagtgtgacaccttgcataagagtatcagctacatgcaattgagtagtatcaagtaaaccattaacttcatctaaaatactattaatattatcacaaaaagtgccatactctgacaataagtcatggcaagctgcataattagaacagacaaataaagaacaatcaatagtaactttaggagaattagtttgaataaattcctcttgaccaactatagtaaagttagtgggaattttgatctcataaagaccacccacagactcaatactgtcattaacaaaactgacattaaagggttcaaaagtaacaaaacgataagaagcagaaatacttctacgtttacgacgcgaagaggaagaagaaggtgagttataatcaacacaaaaaccactacccatgcgaagagcacaagaagaaacagaataatcagttaaattatcagcattaaaaacgcaaccaagataactatcaaaatatggctgagtagttaaagaaatattattcaaaacatagctacattttaaattacgataaagtaaagccaaagaggaagcattttgatgaaaagcagcagaaactcttcctgcataacaagggaaaatattatatgttttattagtaacaaaatctttaaaaccaataatgttgccattagaatcatacaaaagattttgccaactattataataaacagcagaaacttctttaaaaataccttgtcctgtaataccataaaggtcgtaatcaacacaaacatcagtaaaaacttcagtattaggctgcaataaatcattagaacaagtggtaccactattgataccatttaaaataaaattagaaaaaatattacaacggttgttactgacgcaagtgtcataagaccaacctagaaaggcatcagtactacaaagacaagaaacattatatgatccatccaatacaccacacttttcttcatcaacaccgaaccctgcacaatgttcaccaacaccaaccagagactttttttgagaacaagacctagggtcataagcagttataggatcaggtaaacaagaacacctacaccagtcagtgtggtcgagtacagtagtactctcacaagaacgataattagtaccaataggacaggaagcagaaggtggtttatgactcttgcaacttgaagcaaaagaaggtttagcacaaggacaaaaagtattattaacagaaaaacaataacgtgagtaaacaacactatgagagctcaaattaaaattattaaaaccataccttctattccaagaagaaggattataattattaatagtaacattaattgcaggcaaactataatacaattgacaagaactagaagtagtgtcaattttataattagaagattgcagaaaaccagaactgcccaactgcaaatcagatcgtctggagttgggtatggcaaatttatctaaaacaatactcttaaaacaactaccatatatcttagattcatcaaaattattacaagaaaaagaatcagtatgaactaaacgaagcaaagtactcaaattaaagttgcaattagaaaaaattttacgttcccaattaagaggtgagggtacattaaaattgttaagccatttatcaatgtcacaatcaggtaaatcaggaatacgacgatgtacagttgcaacaggcttaacagtaaaaccagataagtcataaacaccagtattaggtaataaagatttagttttacattgaatctcgctaaagaaactactagaacaatcaacagcattagtaataacaccacggttgtcaaatttaagaagatattggcgtttagacaaaggtgtgacccaatattgtaaagtctcattatcagtattagaagatatagcattacaagtcaaaggcaaaacataataatgagataaaagagtaccaagatacaaactaaataaaaaagtagtaggcatgccagaatcagcataataagcataaaaagtgccacgttcttgataaaaatgaaaatacaaccaatctgtagaaacattataagtaaaatttttcttgaacagacacaaaggttcagatttatcaaaatgccaagattcattacgagaactacctttagatttacaaatagtatgaggatactcacacatagtgtattgacaagctgtaatctccaaaacaccattatgaggttgaacaacaatagtataagagttgttaataaaaacactacctataactatagtactaaactcactatacaaagttttattaacatacaacttagtattcttaactctagaaaaaataccattattaaaatcagataaaaagggtttctgataccaaagagtactcaaatatgtagtaccttttaaagatagatccctaaaattggcaccagatttagggaaataaccagtaaataatatagtagtatttaaataaacacgatcaagtatataatatgtacccaaaccataagaaacatccacaacatactcacttatgcgaggaactgtggtgtttaaatcattaatagcaaaattagtacaattaaaatcacctataacagctaatgttgtaggcaaaataaaaataattaataacatgtttagatttaatgagatttatcgttatataacaaaaataatagaaaaacaacaaaaagtaaagctaaacataataaaataccttgtaaaataataggcaaaaaatcataaacacaaattggatgtttaataatagaagatgtaggacacctaccaaaagaataatagggccaaatggatgtaaaattatcatataaaaatacaccataatatgaaatacaagaaacattatataaaagaccagataaaatagaaataaaaccactatcaccgtggttaatatcatacttgccaacataattagcagaagaattgcgaaaataacaatatggcaattgacatgcaacagataaagaaatatctgaggcacgctcgttgttccatctagaatcaacaacctgtacaggtacaaattgtttagatttatcaaaacagagagctttagtaggtaaggataaaaaaggtgcagtggtggaaactttataagaacctggtttaagagaaatataaatacagtctaaatcaggataaacaacattagaaaaaccataaacagagccagtatctatgttataatagtactgactaaagttagatttaaaaaggcaaagcggtactaaataaagagaacaacctaataaagtaaaataaacttccttagaataattaataaaaataggattgttaagtgataaaatatcacttttacaagaattaaacttagaaagagaaacattataaggaatatcaacaaaagtaagataacgaaaaaaggccatattagaatataaggcacgataaaatcttaccttgttaagaagccatacatcattactaccattaggaaaacacttaaatctatgataaggattaaaattaacaccctcataaaaaataatttgatcaccttcgccagtgtaattataaaatcgagtgaaatgaaaactcttaaaaatagaatcaccggcactagatgaaatcttaccattgttgcacaaactagggtgaatatccaaataatcaaaatttttaatttttaaattattaatatggttacaatcagaacgactatcaccaaataaaaaccagtcatggtttaaatgagacacaacattaagaggttcattaaaaccataacagaaataaaaaaataaaaaaataattaacatagtttagatttaatgagatctaacaagtatttacaagactatcaccaacaaaaatctctttacgcgtatcgcgaactaataatttacctctttcaataagagaataaactaaatcatttaattgatctggtcttaaattaacaacagcagtgccagccaatttcaaagaaaatttagtcatatcaaataaactataagcaccgccattccatgttgtactatttctccaaaacaaatagttagcatgcataacattgccatctatttcaaaagaagatttacccaggtaatttatacctattaaaaacccttcactagaagaagcatttacattagtacaaaaaactgtccaaaatgcaaaacaactcattaatttatataaatcagcattccaagaaaactctgtaatttttatagctacactaccacccaaagataatttatcacgaattaaatgacaaatgtaagtaaaaaacccatccttactcacattataatcaccaatatttttagtaagaggatcatacatatcagatattatcaaatcccaatgacaatcaaatggtaaagtcatacaatctccaaaataagtaactaaactatcgctaacaaatgggtttaaatcattatctacaagaatactaccagatggtaaccactgtcttaaaacagcagaacctggagctacttctttatcagaccctgcacctaaatgtaaaacacgcatattaacaggaacagctaatgttgtagtattcaaatactgacataattgagtgtacttagcaacattcatcatacagcctgtaggcaaattaataggtttaccataattccataaagagactctctctaatggaacattcaaatacttatacaaaacaggcatagaatagccaggtttccaatcattagtggcttgcattttaggataaaaagtcataattttattatcattacaccacaacataaattgaaaatccttaaaatcaacattaatattaacaactttactaacacaactcaaatttaatgacttaacaatagaaacaaaatcatctaataataaatcaataactgtacaaacactcttactactaccacactcctgatcagtaataaaatatgaatgaatactagaatcatactgtaaaaactcttgaattaacaaattagatttttttttcctacgaaataagcctataagcaaatgcaaacctcctataactttatggttaaaactaccataaactatatgatcaaatgcatagtcttctaaaccatatttagcaataaacagattatcatccatatcaataaaatcccgttctaaatctgagcgaggttcaaaacttgacaatacacgactctgagtaaagatagtaaaacgtgttagagcatcattaccaatgacattacccgcgcaattaccacctagattaccttgtgggctccagtaatggcttgagcataggctgtctgttcggctgaagataacatcgtcaccatcttttctcatagcgaaccaaaactcaactttgagttctccaactttatccacaatcacaccatttaaatcagctcgttgcggacctttaatcattgataacctacttaatttttcagtactaataaaaacaccatttcttgcttttctaaaagcttctaaagcgccagtgtcacgaccatcaaaaagtatattcaaattttcgatgaacttcaaatctgtgtatttacaaacaccataagtggaactacaaaacaaactatctttaacataatcccacaggacatgcttccaacaaatatcaatgttcaaatttctaagaatcttaagttcagggtggtgccggatactacgttttgtaaacaattcaacagctatattagtaggaaatgatgtattatttttaaaaataacagtatctacattattaatcttaacaacaactttgtcattcataatagcacaaggtaattcacctgtacgtccatcataatgaccaacattaaccaagttatatattacgttttctaaactctgtaacgtagtaaaagtgttccataaattataaaaatcaaaattcttataaacccaaaaagtaaagcctgctgtagtaactatattataagactcaaggtagttacaatattcttcagcatgctttgaacaaacagctccacctagattacaccgtgtgatacaagtggcgcttcttaaaggaacgtaatcaacttgtttagattctaaaccatctacgtacacacaaggcgtatctgaataatagaaaaaaggcataggcttaagattttcaaaaacagttctagtaaaaggattagtatggaatgcatgtttattaacatacaaactaccaccattacatccaggaaggtttaatttatttaacactcgagtgtcaaatctacaaacaattgaattagatggatatttatcaacattacaattccaaaacatacataaaccatctttaaaattatctttatgcacatcatagacataaaataactgtttaacagacttggctacaggaaaagcatcataaaatttaaattcataatctttgacacaagctaaacctttaggattgcctatgtcataacataagttgtatctattacatagcatggcagctttaagcatgacacgctgcaataacctacaagatgtatttatactgacctcattagaaattattggatactctaaattccaattaacagatttacaaaaacaatcatagattgctaaacaacgagtcataattgcatcagctgacgcaacatgtgcacctttatgtacattacaaattatatcgtgattactagttaaagaacctgtataaccccactgttgtatatctacaataagtggattatacacataatcacaagtataactatggcgccaacaaccataataaccagttctagaattgtagcatgtagcacgattagaacacacattacaattaagctctctgcctaatttagcaaaataccttaaacaagtaagttcaaaactggcagaccaagtaataaatactacactatcagaaaggtctaaaagataatcagataacatttgaacaattctaattctaacaatatcccacttttgaccttttgacataaggggtattaaatgtttaaatttttcaccaggaggagctttagctacagtttttttaaaagtataacaatctctctcagcaaataagccagtagcttcaactacaaaatccacaccagttgaaaaacctatttgcagtggaaagtttgttccaatgttttcgcgagtagcatgagcgccctcaacatcaaaaccaacccaacctctaacacgtttaatggcttcatctttagtaataaacaatttagaataaccatcaagagtcaaatctaatttaaaacccataagagatattaaacgagaatatgttaaaacaggttcacaaatatttaaatttacagccaaattttcattaaccttatatttatcatcaactgctaaaaatgagggggcatgcgctggatgataacctaagcaacttttactacaatctttaaaaagattagttgtgcaatgcaaacgaggtaaagtttgattttgaattttatctaaaggtagagtaataaaattaagagattcaaataattgcatattactcataacacaaaaaatgcccttcttggctctagttatggcaacattaaatcgattaacattaacagaatgggctgtttctgctgtttgtgaatatataacataatcatattccgaaccttgagcagaatctacagtttgtgtttgaacacctaaaacacgcttagcaacataattctgactattataaggactaataaaaacagcactattccaaactggattagcttttaaaaatttactaattagatatatctgttgaatatttacagcacttgaactctcatgtgttgtctgtcccttaaaatatactttaaaacataatgaactattatcatttttagccttgagtttattatcataaaccaatgctgaaacagtttctacaatttctttaggacacctataacaatttcccaaaaagatatcaggacctaaacaacacattattttagtaatagaattgaagtgcctaggttctaaagaacccttgctcaacagcacacgtggtgcaggtaattgagcaggatctccaatatatacataatgtttagctttaatacgagcatttataacagacaattcataattagtaagcatactaacttcatcaacaacaacaatatctgtaaccaactctggtaatgcatttattgtggtaaaaacatacttacaagtggtatcattaattttaaacttatcataacaatctacacgaactttagcaggaataatacgtgtacaatcgttaatatttaaaaacttataagctttttcacacaatgcatctacagcagcatgactagcagcagtataaactacacgtgctgtgtagtaataaacagctagacctatagcaagatgagactttcccgtaccagggggaccttgaacagtgcaataacgtttcattccaatgtgctgataattagcaacattattttgaaacaccaatggaacactataaacactagaaaatcttatactagcatagttctcttgtgggacaagtgtaggtgcacttaaactagctacagaatgtgatgttaaaacaaaaacatcacctatagaaagtttataagtagttgtagcgcggtaatacacaccgttagttaattcacttttatcaaaaacatactcacctaaaactgtcttaccagtactagtaaaatggtagcctgtgaaaacataatttttattaagtggtggtttaactttacctgtctcccaacacaaaataacttctctatcactaacaatctcttgaatggtagcagaagcatagctttgtttaaaagcctcttcagttgccttttgagtttctgcagcaaataactttaaacgttcaatacactcatttgccagaacataatcatcaacttctgtccatttacaactagctatcttattaaaatcatctatataaggtgaacccgtgcaagattgtttatacaaaccaaagaccataccattcataactaacttaaatgaataatggggtttatggttttcacaatagtaagacataccgcccaaatataatttggtgacatcactcacatcacagttaggtgcattacaaacgtaaggtgagacactcaaaacatatttatgattagttgccataacatggtcataacaacatttacaacataacaaaggcttacgtatacaactgccacaacgcaaagaagtttgtgatgaacaaacaacgcatgcacctacactctgcatcacggcactttttaaatacatattcttgtaaaatgattcttcagtaaactttaaaccatcacaagtacttaaaataacactataactatctaagatctgagtaccaagatcattatacagtttttttatatattctaaatatacacgaaagactttttggtattcttcattttcatgatgtactaaagggtaagcatctatagctagacttacaaagcgctctatcaaaagaacactgtcagtcttcaataaatcatcaacaaaacaaccagctcctaaaattctagaaggatctggatatggtaaataaacataatcaccatctatcttaactaacatagtatgttgggaacaaaattcatgaggaccattagtaatatcattttcaacccaacatttagattcagacataaagacattattctgatagtacaaaacttgttgaaaaacacttatattagctatataacccttactagcataatcagagttataacagacaacaccatcatcactcaaaatcatcatactaaaatgcttacataaaaattcataatactcattaacaaatgtataatcaacataatctgtacgataaacattagagtataagcgtttttgtaaattgcgtatacttaaatcttcaatcttatggccattacaggccataagagaacaaacattagcagtaacagcctgacatatattaaaaacagaattagcaaaagcagtagttgcatcaccactgctagtaccaccaggcttaacataatagcaaccgccacacataactatttcactcaaaacttgagcacattcattcgcaaggcgataaaatctatcaccatgtgaacaacaaaattcatgtttgcgggccaaaactaaactactaacaatacgcaaaatatttggcatagcacgatcacatttaggataatcccaacccataagaacagggttgtcaacatcctttataagatgacgtaacatatcgtcccaaccaccataaaatttagtggttcctataacaacaggaacacctcgggtagctgctatactcttcaaacatttttgatggaacattcggcctgtcatagtactaagaatagaaacacctgctacagtgcgagctctattcttagcactgatagcatattttaaattcatttgagttaaggtgggcagaacattacgtttagtatatgcataaatttcattctgttcctcaaatgataatgcctcataataaagtctggctttaccaaatttattaaatggataaccagcacttttatcataattattaacaataacttgtgatgctggtatacaaccaccatcataaatttcaaaatatttataaacaacttctaatacaaacaataactgcttaatatcaaccatagtaggtaaattatacttataataattataatcagtaattgcagcattaccatcttgagtaaagaaaaaatgtttcaaatcaactgtactaccctctttaaacaagcctttacttttaacaaactcgtaaaagtcttggttaaagttacctggttttacagtttgaaattttataccacttgtaatggcagctacactaaaacaacaagttcgtaaatcaagcagagcactagcagatgcaacgtgcatagcaggatctgctgcataaagaagtaaatctttaagagacaaacgataacggtgtgtgtcaacatctaagttcataactacacctaactctttgtaatggtaaccaatagaaacaacaaacggtacaccatctacaaaaatttgtctaacaaggggaccaaaacaagtattaggtaaaaccatactaaatagtatattaaaattagcacaatgaataatacacctatcattatcacaatccacagtattaggatgatacttcataccccaatacttaaaatacttattaaacaactctaacttgtaatcagtaaaatcatactgtacaagatcgaattgtctataactatcattaacaaataattcacaatctaatacatgacacatagtcaacataggcatcatataagaatagtaagaatctgcaactgccacaccaaaccctggggctgtttgtataaaatcaccaaaatcataccattgaccatacaaatcttggttatctaaagttaaaacaccaactaaacctacttcaactaaggtgtctgcaaaaatgacagtattaagtaaagctctattaaaaatagggcctaattttttatatatattaataatatcaggattttcaacaaaatcataccaatctttcttagaaaagtaggattctttacaatcagcatactcacaaagaatttcacacaatattgaacaatcattacgatcaaaatgacgcaatgcatagcaaagatctaacatagtatactttgaaagattcctacgaactatatgtggcacgcgactaccatcaatatcaaatgtaaagaaatcatgttcagccacaacaccacaacttttagtcaactcataataagttttctctttattataaacttctaaattagttcttttgacaacaaagaacttatccaatttattaccgtcgtcatctatacgctgaaaacggcaacaattcactttataatataaacctataccagctctattggtattacaaatgtcaaatgcccttaattgaacatcagtagataaaccactagcacagggtactagccgggcattcacactagtaccccgaacccgtttaaaaaatttaaatctttagattgaacagcgacacttgaacctacacaggaacaactgccatctctccaaaaaccacagacttgacaaacatcatgtgttaacacataaagaataggatcttttatacccaaagggacttgtacaaatttaccacgtaatttacatataccatctacatctggatgctctacacgtgcacggcaataaatacaaactgaggcaccaccataagaatcttggttaatagtagcctcaggtttaatagtaatggccataccagtaccagcatgatcacagagcattttaacacaattaattataggtacaccaccttgttgtatataatctaaataagttttcttaggatctacagaaaatgcacataatgaaagtatagaagaattagctgcatactcagtagcaacaccagcctgcaatctaattgttgaagataaagtaccaacaacccaccctctagctaaagtgttacatcctttaataaaataaagatacttaattttaagtcccttaacatcttgtatagaaaatttacaaggaggatcaagctctaaaacaacacaatttccatcatctttcattatcttagtatacttaagaccatcaacatcactaagaacagcataaactattctaccactactaccattattataataacattgagtaggaatattacaattcatatcagaaccactattaacaacttgtatttttaatttatgaggcatcaactcattattctgcataacagcattagcaacttcattatacctgttcgcaatgataacaagaggccaattagaatcaacactaatatcagttaactgtttattaataccatcagcatcttgaacagtctgtatatgccatacactaccagcatatgtaacataaacattatcaacaactttatcaaaaacttgtttatctggtattactatagttaaagtattagcagccaatgctggaatagcactcaaaggtacacaacctttaacagcattatccagaatagaatttaaagcctgattatccaatttacgaaccatgctaaaaagcattgtctgcaaagcggaaacaactttactcttcttatcattaatccgagcctctttatacatgttagtaagtgctaggtctgccatacgttcaagtttgcgagctacagctttatcacgttcatacacagacttagctatattacatgctttttctaactgttttatctgttgttgattaacagaaccactatttttagcatcagccaaatttttctttgcgacttcatattcaacaaaactagccatatttacaaactcactttgcaaagcctgcaaaacggtactatcttgaacataatcatcgctaacttcatctatacttgcaagacacttagtatcaactgcagcaggattggcgaataaaacaatcaataattgagcaagcttatcaaaagctacactcaaatctgaagtagatagtatttcattatgtaaaacactacaatactgccacaacttagaattagaagcaacatgcaaatgctgtaaacaatttaacaaaacaacattagcacatttcacatcagtcaattttgattgaatttgggagacttcaataactggcacgccacctattccaagcagttttaaatttaacaaaatagcctcaaaactattacgaggtggacgtaagccattagcattcatataacgcaattcttgaacagaaattttataattataaacacccataggcattctaaaaacactgtttaaaagagagaaaaatccccaataacaagataaaatataccctataaataagtaactcaagagaatcaatttaatataaggtacatctgtaaaataaaatatattaacagacaaccaattagcaacaatttttgctatagctaatgacaaaatagtggtccatgtataagtacctaaaaaggctgtaataaataacaaaacatcctcttctaaattcgacccaaaataccacatagaaattaaagtaactattctaccaaccaaaaacatcaaagaaaaaatgtcatgattaatactatgcatagttataaaaatagcaaaaacacataaaatacaaccataaaatacttcataaacataagtaaaattcacagcaggaacaaaatatgagagccagacataagtaaaacctctaaaaccttccttataaacaactaaataatttacataaaacaaggtacagagtacaggaattatatacatagtcaaataaaaatgcttatgtttaactagtaacatcataaaactaacaaaacaaagtacacataatgtaacaccaatcatatgtgtattaatatacataaatatagtccatttaacaaatgcagaaattatacaactaaacaaaaatgtagatatcaaaatccaataaattgtttctttaataaatctttttgttttagattgcaatttaacaccagccaattgttgataaacgtcagaaggtgccaattcatcttcaaaagtacaacttcctagtatttgacgaccttgaaatcccatatatagacgcttaatagcagccaataaagtttcaatagaaacacctgtcattgaagccaaagcatctaagacaagatctgcttttacttggctaaaaccatttgccatagcccaaacattaaaatcttcagtagaacaaacatcattttgtacaaaccaagcacaattattaagtatagctgcatagagccaagcaataacattaacagtctggacgtagtccttaactggcaactgtacaacttgagcatctctatatggaccataaaaattaccagtaaaatcagtgccagtgtgacaaccagtactgagctctaattgatgcatatatacaaacttaacactatcacctgttaatacataaccaacagatccacatgacccacacaaaaaagaacctttaatagtataactactacgcatagtaacatgaaatgccccttgtggtcggccattatacgcagctaaaacagtaaaagtttcaccaggtttaacattaccaaaagtatattttggagtgtaaggattttgtaaagagactgtcaaaacaagttgacagccctgcatctggtaagacacaactgttaaactcatccgaccagacattatagtaaaatcacctagagtaactctacacaataaggcagaataatcaggttcgttcatattagaggatgaacatataacatgacgaggacaataaactttgtcatctaaccataaaccattcaaagtcatactaccataagtaacactaacaatacaaggttcaatttttgacgtaggagataccatctttacaatacctgattgcaaaaaagatgtagaaacagatgctgtaggaggttggtataagacatcattaccattattgtgattaaatgtttccatagctttagctaactgagaacacgccgcttctctataggcagcagtatccattttaccactatagtaacgatacttattatacaaactcaaatatctattgtaggcaacatcagaaacagaattctttaatctacaataagaatctttagtaatcataaaagtagtaagagatgtttcttcaaatgtactatcactacatacattaacaccaattttcctacaatatgaaaataaccataaaacatggtttgcaataaccatagctacatatgtgacacaaaaccaaaaaggcattatagcaccatacataacaatccattgcaaatgcataattacactaatttcagaaggaaaatacaatgttacataaaaataaaaacaagcataaacacatgcacaaataggataaacttgaaaaacaaaaagcataagaaaattaatacaccaaacaacaacatttataactacaacactagtataatctccaaaagcacgcttaagttttattaaataataaaaaaccaagacaacaactatagccaatatagctccaaaaatagaactagcagtaagagaaaagaaatctataggacgaattaaactactaaaaaattgataaaacaaatcaaaaagatctctaccacaaaaagttccaggcatacttctataataatcattattcaaaacccaggaactattaaaattaaaacatataccctcttcggcgtattcacatgcacccactctacaataagtcatagagcgcgttcttacaatacgtacaataccttcactaataacatcaggaaatcttataaaaccattagaattagcaaggctataacgtgtatgtggaaccaaagatgtatacaaagaagcattcttcataacaccatctgaataacaataaggatgtggtgtaccatcacctcttttaaacatagtacacaaagatgataaaacacaaccactagcataaaaatcattataagaaatctgaatatgtggtgtatagcactgaacactatcactagcaaatgcataagttaaaaaatgtaaaacatgaaagccatgtctcaaaactttagtaggaacattaaacatagtagaaccgatatcttcatccataactgccactacaatagggcaatccatagaattatgatagtaaacagacccaaaagtggactcataccattgatcaaattggaaaaatttattagcaaaacataaatcattaactgaaatatctctaacaacaccattatcaataactttaaaactagcataagcaggcaaatgaatatcagacttataaacactatatgtaggcaataaagcccacaataatataaaacagattaaactaacaaaaaataatatatataacaaattactcaatacaacacctcctttaagtgaaaagggtgttgtaagaatagggacacttgcctcttgcttattaaaagtcaattttaacttcaagccagttttaacacatgctttttttaatttatgctgtaaatcagcagtaagttgattaaaagcatcaataaaccatatacaagaaatattagctgccttagcaacattaccctgtacatgcttagcaccattctgtataagaacacctaaatcagcagctacaatattatcactctttaaatatgtaggtaccaaattgttataattttcatcagtaaattccaaaccagcagctactgcagatatcatagatttagtaataaatcttgtttcaacatctgaatcaatggaacaacatttacgtacacatcccacaaaagtatctaaaaccttttctaattgcacaccctctctaagagaagcatgagcaatgttaacaaaattattaaaactctttctatcaacatcaaaatgagacataaaagtatcaacataaacatcaaacatagtctgggttacagagataccattacaagctgtagtaattaactttttgtctacaagtaatataggcctatacaatgattgtgcataaaacacaacagcattcagaaaattagctctatcagcatcactctctactacaactacatacaaattaggaacaactttaactttagaatgtaacagattattaatatctacaaataaactagcatcaacatcatcgtaaacacgctgtccatctctatcatagaacaaacgcatcatacaaccaacttgcttaatatcagtaactacataatgtgaagcatcagttggatttacaggtcgtttaagctctttagaaagttctatagcagcttctacagttataaaagtgttacctggtttaaaagaatggcaattaaaacaattccattgatgtttaacacaaaaaccagtaccaccattagcagtaatatcataataacgaattacaccaccaacaatagtactacacttaacacgaacactacaatttcgtttataacaaaataaacaaccagctttattacaaccatagacaatatgcctaataaaaccaactactttatacatagcagtaacaactatataaaaccgcaacaagacaaaagcaggtaacatattagctacaaatacaataaatctaatcaaccaatgcatagtttctaacataaacaaatcaggcaaccatgtagtaaataattgtaaaccaataagacaaaataatggataaaaccatactgtgtataatgaataaccaataacgagttcaacaattaatttgactaaactaacataatcaaataaaacacgtctatctacttcatactgaacaaaatctatagctgcatatgtatccaacatatcaaaaccagaatgacacaattcacatataaaactaccattacaaaaatgacttgtaaaacctacacctaacttagaataaaaatcacaaattgtaaccaaaccaaaagtagcctttatccacataacaattcttcccacaaaaataggaaaaacactaatattaggaagataaaagtcactaaaaataacatttatatacaaaaaattaaaccaaaacaaaaacacagtggctacaacaagaaaaccttttataaatatactccatctaaatgtctgaaaagcatttttaagagccaaacaaaacaaattaaaagtaaacttagaagctatttctgtagtataaaaaatggttttatcatttgtaaaatgtaataaactaaaaacataaataaacaaccacttcaaaaaaccataaaattctatagctcttgctttaaaaattttaggaactaaaagagtttgattatcatctcttaaacataacaaatctataggtatagtaataggtttaataccatatcgtatatattccctaactgttggtgatttaactaggcgtgacaattcattagcaacccaaacaacataatcacaacctgtcaaatacatatcccaaacatcaactaaagataaacttttaacaaccttaatagaactattttcatcattaacaataatagcatcttctattttaacagtctttctaacaccctttaacttaacctctttagtactaatctgcgattccataacagaagtaaccacattaccttgtgactcctcagatacagaatcaacagacaaaacactatatctattttcagatttaaaactaggtttattaaaataagtaagagaattcaatgatgcttcatcatgacaaaaccaaataacaggcttaccaaaagtttcacatcctttaaaataacgtttcacatataaatcatcagatgccaaaacaacatcaccagtagctacaggccagactgttactttgtactcaacaaacggcaaatctacattaaaacctaacttatcattcaattgagcacaaatatcatgtccaactaacttaaagttagtataaacaccgtcaactttagcaaatggtttaaactgagcctttataataggttttgtataatacttaccattatcacaataatattgtgaaagatcagggttataagcaaccatttcaacatcatccaaaaaataattagtcaacatagatgtaaaagtctgggttaaatttttaagatacaagcagtcagttaaacaaccactaacacctgtatattttttaacactacaagcatcataatgttggtaaggtgaaccacatttcaaatgtgtataatggcctacacctacacccataaacatgttagctgcaacaacatcatcaggtaaatccttactcagaggagtattagaacaaatcaaaaatggtacattcaatttagtacaatggacaattctacctgcacaattacagccaatcttataaccattaaaaagatcagtctttgctaatgtaccaaaatgcataacagcatcaacaccaacacgactttcttgtttaataccacaatcacaaataagttctaattcacaaattgcacctgataaatcagcttgtttcaaaacaacacgaataaaatcagtagcatctgatggttcatcaaatttaaaatgacctttagctaaaacaagagcaactaacctatgtggtctgccagcacgaaattcataccatgcttcctgccactgccatttattaaatttaagattaatatgctgcaacataagacaagctacattcacataacaattattatgagactgttcaaaagaaaaaaatggaccgttaacaactacagaccatttacatactgttaaaaaattataataagcaagcaattgttgctgatcaaacccaaatgaactttgtacagcagaaatatcagctaaagacaaattttcatactgatataaaattttatcggcataaaaatcactacactttaacttagtaacatcaatgccatcacagaaaacattaccaagtattttaccaaaaacttcacctacagtaagagaaatagatttaaaattaacaccatctacagtaagcaaaacatctatcttcttagctaataaaacacaaacttgattaacagttgctttataaaaagaaccatcacatacataaccaaagtctttaccctgactacatatataaatagaattaggacactcaaaatacttaacagttttaacaccgttaataacatcaaatttattgataagacgccaatctttaggaagactagtcatcttagacaacaaataatcacgaacgtcattattcaattgtatatcatgacgaagcaataaaacttcttgtataacagaagaatttgaaacaaaacaatcatcaccactcaaaaaaagtttgtatgcatctgtctcaaatttaataacacggcctacattagcagttaatctaacagccaatgctttagtaccaacaactgaagtaatttgacatttttgaataatatcaaaatcttctttattattactaacaaggataacttgtttatcaacaacacctagaaggtaagttaatgacacatcagcaggaacactaaatataccagccgatatgagagtagacaaacaacaatcataattattaagatgcttataagcacgtgctaacaaaacataagattgtcttccatcttgtctagcatcagggcctacaatattaagaattgttttacataatttaccaccggtagaaacataacaatctcctacttggcaaacacctttagatttaaccatagcagcagtttctttagaaaattttttacctgcagctacagctatagcttttgcaactccaccaccatggagcatatgcccattagcaggattaacaataacatcagctttaacaagtctagcaacatttataatatcacctttaacaaaacatacattaggtgttatacacaaaccatacaattgaggtaactcaaaagaagacatactaaatgacattccataacctactataaaatcaaatttatcaccactaaatttagtaacaaacttaccatctatttgttcatcacctataacagctacagaatgacaaacgtttacatccacagcacatgcagcaataaaaatttttttaggggtgcaaaaagcacaaaaattgtcatcaaataatgaaaaatgtaatgtacaaggtaagtccgctgctattagagtcatattatgtccacacttacaaacatgagacacaatatctccataaaaaaacaaagcatccaaaccatttaaatcaaaagaaaaaccacattttaaacaacaccaattagcatacgcattaatatcaaactggtttaaaaaccaataagcaaaatcagctacaaaaccaccttgaggcaaaacaatagctttaggaatagtggtcagtaaataatcaacaaaactttgattataacccaccttataagataaccacatattttcaatagctaaatccttaaacttaaaaggtaatttctgcattacaagtaacacagaacgcaaccaacaattagtatgtgtaatagtaggtgaccataaaccattaactttaaaatatgtttctgtttcaacactagaaccataactaacaaacaaagcatcattatagacatcattaaaaactaaaagagctttataagtatcaaagtcataaatactttcaatatcatctacatcatcaccagtaacaacaatttggtcatcattgtcaccagtaacaatctcttcatcgttattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattaatagtgtcttcaacgacaccatcaatagtatcttcgacagcttcactactgataacgtcttcaacatcctcaatagcaaaagtacaatacatacgagaggccattgcttcatcaccagcctcatcaaataaataaacaacattctcattaagtttatttaaaaatgcacgaacttgataaccaaccactggatgctctttacaagagtttaaagcattctctatagcatcacaaacaacagcaacaaaatcatctacagtaacacccttttctacttcaaattctgaacaaactttacctaaaatatcatcaaaagtagaatctaaatcaaacataaccttaactgtcatcaaagacggaatctccataacaacaggtttctcgttaaaattaacttttctacctgcacatggaaaacgccaagcctgatctaaaagacaaatatttttatcattcatgacaatagggaaaaatttatcaccacacttacccatgtacatattatctataatacaaattttttctacagatttaggtggttgacaatactcataagatgataaagaagatttgacattctcaataacatcatcttctactataacagattctgcaacgccttcaaaaaaataaatttgttgttcctgtgcattacatggtaaaacaaaaccaggaattaaccctgtactaacgttataaaacttattgcctacaatacaaactaaaccattaatagttttaagaacaggcatatcttttaaaacatcaactgtaacacactctaataataacttaaaaaaagtgtaaaatttattaactaaaattttagcataatcaggtattaaagcaacaaaattaaagttggcttgagatactacaaaaagaccattcaataattggtaaagaagccagcctgtagcaggtgcactagcatctaacatggtattaaaccaattaaccattttattaacaagtgtagtacccaataacttaaattgagtaaccaacctattaacataatgctctatataaaatgtagcaactgaaactctgtccataaacaaaatacacatttttaaacacatatcagaaacttcttgtgaaaattgagacatcaaagatgtaaagaaaataccactctgaattagataataactacggggaattaaaccatctagtaaaaaaggtacaaaaccatctccacaaactgcaaacttgcaagcaaaatcagcacgacgcttaacaaacaagtcaatattttttagaagcatattataatcacctctattaagcaacagttgcctacaccaagaattattaacgccaagaatatgattttgttcaagattaccacacttacattgaacataatctaagtaaagtgcatgagtaataagagcagtttctttaacaatagatttacaacctactacacctgaataaaccaaatcatcataagacttgactgaagatttaattataggaatccacaatccaggacgcggcgaccaatatatacaagaaccaaatggtgtgacagaataaccatacaaattaaaagaatcatggttaacagtatcagtactattagtaaataacacaggattttcaggaataacaccagatgattgggctttaacttcgctagagtcataaactgtacaacacaatggacaagaaaaaccatccatcatattacctgaaacccaaccataaaaatcacaattatcattaaaacaatctacataaccatactgcataacaaaaccacaatcacacaaatcaacattatatatagatttaatagaaaaatcatccatatgagtcataactttcatcaaactaggaagctttaaaactattgcatcagcagataataaatgtacaggttcacgtataactacatctccatctactacatcttctgtaggttgtgcaacatatttaataccacaaatagtagctatagtctgcaggcgcataacaaatcgtgaatcacgaactacatgccaagccactacaatatcaaagtcacaattggcaagccatacagactgcttttgtctcatatcttgcaaagaataatgaccataagcttgaagacaatctgctaatttaccagaatagtcacaaccatactggtctacaaaaagtacgggtttaataccacgatattgtctaagtaaagcataagctttttgtgaatatttacctttaggctcagcatgaacctcagcataagcatcttctacactaaaatcataatcatcaaatttaaaatttgaaattattaaatcactctcttcaatatacaacctacagaattgaaaccatttgtgaacataagatggcataaaaccaaaaggtacaatccaacccaaaaaatcttcaccaaaattagtagtagatgtagtcatagaaagatgatgtacaacataacgtttagtcttgtatgaacggaacaagcccataacataccctttaggaaaaccacccaagctatgcaaaggtgatttaattaaaattgccgtaccggactttacggctgttttagttagaacttctacaacatgtagatcttcatgaacaaaaatatcacggataagatttgactgcacatgccattcttgtccaagaatgcagcgacaatctatcttcacatgattatcataaacgaatccaacactttccatcgcttgaccagtagaggggcataacccaccctcatctgacttcataggactagccaactcctccgctgcatccggaagcagccaacgaaattctggcgcccacttgaagccgagaccgtatttgctggttttaatcattgcgacctatgggagggacgctgaggacaaccaacacgtcactggcagagagatgaaaagtgtggaaagtaaaatacaagattatgattaaaccacactcacaagcatggataacagggaatcttgtttaaaaagtttagatttaatgagatctgacaagagatcgtaagctgatagacggtacggacgcaattcgctcttattc

SEQ ID NO: 1320 - protein, 12 aa, Corononavirus-HKU1
FFFFFCNSSKRL

SEQ ID NO: 1321 - protein, 6 aa, Corononavirus-HKU1
LISIIY

SEQ ID NO: 1322 - protein, 33 aa, Corononavirus-HKU1
TLQLIALPGGVYTTAKPYNYSNNQMSKYKISTN

SEQ ID NO: 1323 - protein, 36 aa, Corononavirus-HKU1
YIVCNNLLYLLLQQEFILIESVLFRIIARGYHLVSN

SEQ ID NO: 1324 - protein, 19 aa, Corononavirus-HKU1
DSFSLSNRVFYIRIIKSSK

SEQ ID NO: 1325 - protein, 9 aa, Corononavirus-HKU1
TMILRSKII

SEQ ID NO: 1326 - protein, 7 aa, Corononavirus-HKU1
NVLSTST

SEQ ID NO: 1327 - protein, 8 aa, Corononavirus-HKU1
IKRVKLFW

SEQ ID NO: 1328 - protein, 27 aa, Corononavirus-HKU1
LFNTSFTLRFRTQRIRISVLIRINVSI

SEQ ID NO: 1329 - protein, 13 aa, Corononavirus-HKU1
ILFKNFHNCLKAW

SEQ ID NO: 1330 - protein, 19 aa, Corononavirus-HKU1
STIKPNRTRIMKFKNIFNR

SEQ ID NO: 1331 - protein, 10 aa, Corononavirus-HKU1
VSLGISFNQV

SEQ ID NO: 1332 - protein, 12 aa, Corononavirus-HKU1
FRTKEKSTWCRS

SEQ ID NO: 1333 - protein, 14 aa, Corononavirus-HKU1
FCKNRKLRIISTKL

SEQ ID NO: 1334 - protein, 33 aa, Corononavirus-HKU1
HFSITKILRRSSFTKTLLNITMFIRSSLLARFC

SEQ ID NO: 1335 - protein, 24 aa, Corononavirus-HKU1
NFMPDFLGILLSDLLRFRIFTKLG

SEQ ID NO: 1336 - protein, 16 aa, Corononavirus-HKU1
NKISDLISHIRFYYRI

SEQ ID NO: 1337 - protein, 9 aa, Corononavirus-HKU1
MSKIRITST

SEQ ID NO: 1338 - protein, 6 aa, Corononavirus-HKU1
TIIGST

SEQ ID NO: 1339 - protein, 10 aa, Corononavirus-HKU1
TWSTIRSRPS

SEQ ID NO: 1340 - protein, 27 aa, Corononavirus-HKU1
AFNIIALRQNRTRRKPSRDSFLSSRIP

SEQ ID NO: 1341 - protein, 42 aa, Corononavirus-HKU1
RNIGGSRSVSLVISNPEDPFEGFTIGCIGIWAGTEIVEIPSR

SEQ ID NO: 1342 - protein, 38 aa, Corononavirus-HKU1
QLLLLTISCFKRTPAVSIPISFCFRRGYSESNGNSLTI

SEQ ID NO: 1343 - protein, 60 aa, Corononavirus-HKU1
KFKVSTFLKLSDPGEPGIMWDSISLWLSRHSEFRLGFSASIKGLVISLRLVSPRSFLEDS

SEQ ID NO: 1344 - protein, 26 aa, Corononavirus-HKU1
TISRGASTSSIMTGSIRHPNSLDLSS

SEQ ID NO: 1345 - protein, 12 aa, Corononavirus-HKU1
QGSIHTTRFTRR

SEQ ID NO: 1346 - protein, 18 aa, Corononavirus-HKU1
TIVTNFRLNKNSKTTINI

SEQ ID NO: 1347 - protein, 21 aa, Corononavirus-HKU1
KGTFIGTKYLHLSYSNIYGQI

SEQ ID NO: 1348 - protein, 22 aa, Corononavirus-HKU1
KSITSAKFDTLYIKMTTNNSSS

SEQ ID NO: 1349 - protein, 111 aa, Corononavirus-HKU1
CVIVLNNWPNKHLAFHINTHKIIGLWIKTPPTASSNKKPNTINKIKNPYNNRNNSKHYRKCKKSIIQSIKTIKYSQGDSQWPHKPKNNHLDKINKHTTARITELQYDSNKK

SEQ ID NO: 1350 - protein, 10 aa, Corononavirus-HKU1
YYTQREIPFF

SEQ ID NO: 1351 - protein, 19 aa, Corononavirus-HKU1
ECNSLIRSKLRKKRFIHNV

SEQ ID NO: 1352 - protein, 10 aa, Corononavirus-HKU1
SEVGGITCSL

SEQ ID NO: 1353 - protein, 9 aa, Corononavirus-HKU1
DLYNCIPLL

SEQ ID NO: 1354 - protein, 70 aa, Corononavirus-HKU1
AEGEIIKKLQKPQSCIQSLIVAKKATTKIKEIRQNKTKTKICPMYQAVSLKNKSTILIKCLCTPNNKFRS

SEQ ID NO: 1355 - protein, 30 aa, Corononavirus-HKU1
SRHSLRNSITISSKTSYNTKIITMGNIVTT

SEQ ID NO: 1356 - protein, 15 aa, Corononavirus-HKU1
CKVRSKFAKLATPNI

SEQ ID NO: 1357 - protein, 15 aa, Corononavirus-HKU1
RYNTVTNNRLTVIIL

SEQ ID NO: 1358 - protein, 27 aa, Corononavirus-HKU1
TQIFKVCNTKFSNNKRMCVARSPNVHK

SEQ ID NO: 1359 - protein, 11 aa, Corononavirus-HKU1
SLDLMRSDKRF

SEQ ID NO: 1360 - protein, 7 aa, Corononavirus-HKU1
DVLITKS

SEQ ID NO: 1361 - protein, 8 aa, Corononavirus-HKU1
PPYSSQQL

SEQ ID NO: 1362 - protein, 51 aa, Corononavirus-HKU1
HLLKHAEPQPVQQHIKKSNTRNIINEKEISSQTYQGHFTYISYVPISLRLI

SEQ ID NO: 1363 - protein, 9 aa, Corononavirus-HKU1
LLFKDLIDS

SEQ ID NO: 1364 - protein, 5 aa, Corononavirus-HKU1
IRFIS

SEQ ID NO: 1365 - protein, 10 aa, Corononavirus-HKU1
YKSKKVALIV

SEQ ID NO: 1366 - protein, 11 aa, Corononavirus-HKU1
RFKVKLGAMDV

SEQ ID NO: 1367 - protein, 4 aa, Corononavirus-HKU1
FLNQ

SEQ ID NO: 1368 - protein, 13 aa, Corononavirus-HKU1
DNSDSKSDNFGTE

SEQ ID NO: 1369 - protein, 25 aa, Corononavirus-HKU1
TRGALVKLTEQVFIKTTFLSEIGSG

SEQ ID NO: 1370 - protein, 7 aa, Corononavirus-HKU1
ELPVNIQ

SEQ ID NO: 1371 - protein, 34 aa, Corononavirus-HKU1
SLCLIKYPCLGAIPTSPDIHKPGLTKTVLKEIGL

SEQ ID NO: 1372 - protein, 8 aa, Corononavirus-HKU1
LKCINNKP

SEQ ID NO: 1373 - protein, 5 aa, Corononavirus-HKU1
TNDKI

SEQ ID NO: 1374 - protein, 11 aa, Corononavirus-HKU1
LPLPQKLIRGD

SEQ ID NO: 1375 - protein, 25 aa, Corononavirus-HKU1
LLTHSLTFSIAKAAPNFTREISLSC

SEQ ID NO: 1376 - protein, 14 aa, Corononavirus-HKU1
AFKAVKRPLISLSI

SEQ ID NO: 1377 - protein, 32 aa, Corononavirus-HKU1
ASKASRRDKISCKEELIAPNLLNNCCNKLLSA

SEQ ID NO: 1378 - protein, 21 aa, Corononavirus-HKU1
ALELTTLCILASAELVALKPF

SEQ ID NO: 1379 - protein, 14 aa, Corononavirus-HKU1
IERRALLKAVAINF

SEQ ID NO: 1380 - protein, 42 aa, Corononavirus-HKU1
FLLRTSIVTPKPLILYCTLRENGMPAAADHGGNIAATVAAVV

SEQ ID NO: 1381 - protein, 31 aa, Corononavirus-HKU1
DSDKIGGKTLIPLKDCTQRRSLISLPPVQLL

SEQ ID NO: 1382 - protein, 67 aa, Corononavirus-HKU1
ASTKPTSESLTLSNNKSSKKEREEEPQCGPKHPTRDLKLILSTSKCKLVLRLELSVTPCIRVSATCN

SEQ ID NO: 1383 - protein, 31 aa, Corononavirus-HKU1
VVSSKPLTSSKILLILSQKVPYSDNKSWQAA

SEQ ID NO: 1384 - protein, 17 aa, Corononavirus-HKU1
LEQTNKEQSIVTLGELV

SEQ ID NO: 1385 - protein, 4 aa, Corononavirus-HKU1
INSS

SEQ ID NO: 1386 - protein, 12 aa, Corononavirus-HKU1
PTIVKLVGILIS

SEQ ID NO: 1387 - protein, 23 aa, Corononavirus-HKU1
RPPTDSILSLTKLTLKGSKVTKR

SEQ ID NO: 1388 - protein, 18 aa, Corononavirus-HKU1
EAEILLRLRREEEEEGEL

SEQ ID NO: 1389 - protein, 16 aa, Corononavirus-HKU1
STQKPLPMRRAQEETE

SEQ ID NO: 1390 - protein, 12 aa, Corononavirus-HKU1
SVKLSALKTQPR

SEQ ID NO: 1391 - protein, 5 aa, Corononavirus-HKU1
LSKYG

SEQ ID NO: 1392 - protein, 9 aa, Corononavirus-HKU1
VVKEILFKT

SEQ ID NO: 1393 - protein, 6 aa, Corononavirus-HKU1
LHFKLR

SEQ ID NO: 1394 - protein, 8 aa, Corononavirus-HKU1
SKAKEEAF

SEQ ID NO: 1395 - protein, 8 aa, Corononavirus-HKU1
KAAETLPA

SEQ ID NO: 1396 - protein, 31 aa, Corononavirus-HKU1
QGKILYVLLVTKSLKPIMLPLESYKRFCQLL

SEQ ID NO: 1397 - protein, 14 aa, Corononavirus-HKU1
TAETSLKIPCPVIP

SEQ ID NO: 1398 - protein, 44 aa, Corononavirus-HKU1
STQTSVKTSVLGCNKSLEQVVPLLIPFKIKLEKILQRLLLTQVS

SEQ ID NO: 1399 - protein, 43 aa, Corononavirus-HKU1
DQPRKASVLQRQETLYDPSNTPHFSSSTPNPAQCSPTPTRDFF

SEQ ID NO: 1400 - protein, 6 aa, Corononavirus-HKU1
EQDLGS

SEQ ID NO: 1401 - protein, 26 aa, Corononavirus-HKU1
AVIGSGKQEHLHQSVWSSTVVLSQER

SEQ ID NO: 1402 - protein, 12 aa, Corononavirus-HKU1
LVPIGQEAEGGL

SEQ ID NO: 1403 - protein, 22 aa, Corononavirus-HKU1
LLQLEAKEGLAQGQKVLLTEKQ

SEQ ID NO: 1404 - protein, 18 aa, Corononavirus-HKU1
ELKLKLLKPYLLFQEEGL

SEQ ID NO: 1405 - protein, 11 aa, Corononavirus-HKU1
LLIVTLIAGKL

SEQ ID NO: 1406 - protein, 9 aa, Corononavirus-HKU1
QELEVVSIL

SEQ ID NO: 1407 - protein, 49 aa, Corononavirus-HKU1
LEDCRKPELPNCKSDRLELGMANLSKTILLKQLPYILDSSKLLQEKESV

SEQ ID NO: 1408 - protein, 59 aa, Corononavirus-HKU1
TKRSKVLKLKLQLEKILRSQLRGEGTLKLLSHLSMSQSGKSGIRRCTVATGLTVKPDKS

SEQ ID NO: 1409 - protein, 12 aa, Corononavirus-HKU1
TPVLGNKDLVLH

SEQ ID NO: 1410 - protein, 54 aa, Corononavirus-HKU1
ISLKKLLEQSTALVITPRLSNLRRYWRLDKGVTQYCKVSLSVLEDIALQVKGKT

SEQ ID NO: 1411 - protein, 20 aa, Corononavirus-HKU1
DKRVPRYKLNKKVVGMPESA

SEQ ID NO: 1412 - protein, 5 aa, Corononavirus-HKU1
KVPRS

SEQ ID NO: 1413 - protein, 9 aa, Corononavirus-HKU1
KYNQSVETL

SEQ ID NO: 1414 - protein, 30 aa, Corononavirus-HKU1
VKFFLNRHKGSDLSKCQDSLRELPLDLQIV

SEQ ID NO: 1415 - protein, 7 aa, Corononavirus-HKU1
GYSHIVY

SEQ ID NO: 1416 - protein, 9 aa, Corononavirus-HKU1
QAVISKTPL

SEQ ID NO: 1417 - protein, 4 aa, Corononavirus-HKU1
TTIV

SEQ ID NO: 1418 - protein, 43 aa, Corononavirus-HKU1
ELLIKTLPITIVLNSLYKVLLTYNLVFLTLEKIPLLKSDKKGF

SEQ ID NO: 1419 - protein, 24 aa, Corononavirus-HKU1
YQRVLKYVVPFKDRSLKLAPDLGK

SEQ ID NO: 1420 - protein, 9 aa, Corononavirus-HKU1
PVNNIVVFK

SEQ ID NO: 1421 - protein, 5 aa, Corononavirus-HKU1
TRSSI

SEQ ID NO: 1422 - protein, 5 aa, Corononavirus-HKU1
YVPKP

SEQ ID NO: 1423 - protein, 73 aa, Corononavirus-HKU1
ETSTTYSLMRGTVVFKSLIAKLVQLKSPITANVVGKIKIINNMFRFNEIYRYITKIIEKQQKVKLNIIKYLVK

SEQ ID NO: 1424 - protein, 10 aa, Corononavirus-HKU1
AKNHKHKLDV

SEQ ID NO: 1425 - protein, 12 aa, Corononavirus-HKU1
DTYQKNNRAKWM

SEQ ID NO: 1426 - protein, 22 aa, Corononavirus-HKU1
NYHIKIHHNMKYKKHYIKDQIK

SEQ ID NO: 1427 - protein, 6 aa, Corononavirus-HKU1
NHYHRG

SEQ ID NO: 1428 - protein, 7 aa, Corononavirus-HKU1
YHTCQHN

SEQ ID NO: 1429 - protein, 27 aa, Corononavirus-HKU1
QKNCENNNMAIDMQQIKKYLRHARCSI

SEQ ID NO: 1430 - protein, 10 aa, Corononavirus-HKU1
NQQPVQVQIV

SEQ ID NO: 1431 - protein, 7 aa, Corononavirus-HKU1
IYQNREL

SEQ ID NO: 1432 - protein, 16 aa, Corononavirus-HKU1
VRIKKVQWWKLYKNLV

SEQ ID NO: 1433 - protein, 13 aa, Corononavirus-HKU1
EKYKYSLNQDKQH

SEQ ID NO: 1434 - protein, 15 aa, Corononavirus-HKU1
KNHKQSQYLCYNSTD

SEQ ID NO: 1435 - protein, 14 aa, Corononavirus-HKU1
KGKAVLNKENNLIK

SEQ ID NO: 1436 - protein, 4 aa, Corononavirus-HKU1
NKLP

SEQ ID NO: 1437 - protein, 9 aa, Corononavirus-HKU1
VIKYHFYKN

SEQ ID NO: 1438 - protein, 11 aa, Corononavirus-HKU1
KEKHYKEYQQK

SEQ ID NO: 1439 - protein, 7 aa, Corononavirus-HKU1
DNEKRPY

SEQ ID NO: 1440 - protein, 10 aa, Corononavirus-HKU1
NIRHDKILPC

SEQ ID NO: 1441 - protein, 8 aa, Corononavirus-HKU1
EAIHHYYH

SEQ ID NO: 1442 - protein, 5 aa, Corononavirus-HKU1
IYDKD

SEQ ID NO: 1443 - protein, 5 aa, Corononavirus-HKU1
HPHKK

SEQ ID NO: 1444 - protein, 12 aa, Corononavirus-HKU1
FDHLRQCNYKIE

SEQ ID NO: 1445 - protein, 4 aa, Corononavirus-HKU1
NENS

SEQ ID NO: 1446 - protein, 4 aa, Corononavirus-HKU1
NHRH

SEQ ID NO: 1447 - protein, 9 aa, Corononavirus-HKU1
MKSYHCCTN

SEQ ID NO: 1448 - protein, 9 aa, Corononavirus-HKU1
GEYPNNQNF

SEQ ID NO: 1449 - protein, 4 aa, Corononavirus-HKU1
FLNY

SEQ ID NO: 1450 - protein, 22 aa, Corononavirus-HKU1
YGYNQNDYHQIKTSHGLNETQH

SEQ ID NO: 1451 - protein, 10 aa, Corononavirus-HKU1
NHNRNKKIKK

SEQ ID NO: 1452 - protein, 6 aa, Corononavirus-HKU1
FRFNEI

SEQ ID NO: 1453 - protein, 27 aa, Corononavirus-HKU1
QVFTRLSPTKISLRVSRTNNLPLSIRE

SEQ ID NO: 1454 - protein, 5 aa, Corononavirus-HKU1
TKSFN

SEQ ID NO: 1455 - protein, 23 aa, Corononavirus-HKU1
SGLKLTTAVPANFKENLVISNKL

SEQ ID NO: 1456 - protein, 13 aa, Corononavirus-HKU1
APPFHVVLFLQNK

SEQ ID NO: 1457 - protein, 16 aa, Corononavirus-HKU1
LACITLPSISKEDLPR

SEQ ID NO: 1458 - protein, 55 aa, Corononavirus-HKU1
FIPIKNPSLEEAFTLVQKTVQNAKQLINLYKSAFQENSVIFIATLPPKDNLSRIK

SEQ ID NO: 1459 - protein, 9 aa, Corononavirus-HKU1
VKNPSLLTL

SEQ ID NO: 1460 - protein, 18 aa, Corononavirus-HKU1
SPIFLVRGSYISDIIKSQ

SEQ ID NO: 1461 - protein, 11 aa, Corononavirus-HKU1
QSNGKVIQSPK

SEQ ID NO: 1462 - protein, 58 aa, Corononavirus-HKU1
VTKLSLTNGFKSLSTRILPDGNHCLKTAEPGATSLSDPAPKCKTRILTGTANVVVFKY

SEQ ID NO: 1463 - protein, 18 aa, Corononavirus-HKU1
VYLATFIIQPVGKLIGLP

SEQ ID NO: 1464 - protein, 20 aa, Corononavirus-HKU1
FHKETLSNGTFKYLYKTGIE

SEQ ID NO: 1465 - protein, 12 aa, Corononavirus-HKU1
PGFQSLVACILG

SEQ ID NO: 1466 - protein, 13 aa, Corononavirus-HKU1
KVIILLSLHHNIN

SEQ ID NO: 1467 - protein, 44 aa, Corononavirus-HKU1
KSLKSTLILTTLLTQLKFNDLTIETKSSNNKSITVQTLLLLPHS

SEQ ID NO: 1468 - protein, 6 aa, Corononavirus-HKU1
SVIKYE

SEQ ID NO: 1469 - protein, 9 aa, Corononavirus-HKU1
ILESYCKNS

SEQ ID NO: 1470 - protein, 28 aa, Corononavirus-HKU1
INKLDFFFLRNKPISKCKPPITLWLKLP

SEQ ID NO: 1471 - protein, 33 aa, Corononavirus-HKU1
SSKPYLAINRLSSISIKSRSKSERGSKLDNTRL

SEQ ID NO: 1472 - protein, 28 aa, Corononavirus-HKU1
VKIVKRVRASLPMTLPAQLPPRLPCGLQ

SEQ ID NO: 1473 - protein, 95 aa, Corononavirus-HKU1
WLEHRLSVRLKITSSPSFLIANQNSTLSSPTLSTITPFKSARCGPLIIDNLLNFSVLIKTPFLAFLKASKAPVSRPSKSIFKFSMNFKSVYLQTP

SEQ ID NO: 1474 - protein, 10 aa, Corononavirus-HKU1
VELQNKLSLT

SEQ ID NO: 1475 - protein, 72 aa, Corononavirus-HKU1
SHRTCFQQISMFKFLRILSSGWCRILRFVNNSTAILVGNDVLFLKITVSTLLILTTTLSFIIAQGNSPVRPS

SEQ ID NO: 1476 - protein, 23 aa, Corononavirus-HKU1
PTLTKLYITFSKLCNVVKVFHKL

SEQ ID NO: 1477 - protein, 5 aa, Corononavirus-HKU1
KSKFL

SEQ ID NO: 1478 - protein, 12 aa, Corononavirus-HKU1
TQKVKPAVVTIL

SEQ ID NO: 1479 - protein, 28 aa, Corononavirus-HKU1
LQYSSACFEQTAPPRLHRVIQVALLKGT

SEQ ID NO: 1480 - protein, 17 aa, Corononavirus-HKU1
STCLDSKPSTYTQGVSE

SEQ ID NO: 1481 - protein, 75 aa, Corononavirus-HKU1
KKGIGLRFSKTVLVKGLVWNACLLTYKLPPLHPGRFNLFNTRVSNLQTIELDGYLSTLQFQNIHKPSLKLSLCTS

SEQ ID NO: 1482 - protein, 13 aa, Corononavirus-HKU1
NNCLTDLATGKAS

SEQ ID NO: 1483 - protein, 4 aa, Corononavirus-HKU1
NLNS

SEQ ID NO: 1484 - protein, 13 aa, Corononavirus-HKU1
SLTQAKPLGLPMS

SEQ ID NO: 1485 - protein, 46 aa, Corononavirus-HKU1
HKLYLLHSMAALSMTRCNNLQDVFILTSLEIIGYSKFQLTDLQKQS

SEQ ID NO: 1486 - protein, 25 aa, Corononavirus-HKU1
IAKQRVIIASADATCAPLCTLQIIS

SEQ ID NO: 1487 - protein, 7 aa, Corononavirus-HKU1
LLVKEPV

SEQ ID NO: 1488 - protein, 13 aa, Corononavirus-HKU1
PHCCISTISGLYT

SEQ ID NO: 1489 - protein, 6 aa, Corononavirus-HKU1
LWRQQP

SEQ ID NO: 1490 - protein, 5 aa, Corononavirus-HKU1
PVLEL

SEQ ID NO: 1491 - protein, 43 aa, Corononavirus-HKU1
HVARLEHTLQLSSLPNLAKYLKQVSSKLADQVINTTLSERSKR

SEQ ID NO: 1492 - protein, 4 aa, Corononavirus-HKU1
SDNI

SEQ ID NO: 1493 - protein, 10 aa, Corononavirus-HKU1
TILILTISHF

SEQ ID NO: 1494 - protein, 25 aa, Corononavirus-HKU1
PFDIRGIKCLNFSPGGALATVFLKV

SEQ ID NO: 1495 - protein, 35 aa, Corononavirus-HKU1
QSLSANKPVASTTKSTPVEKPICSGKFVPMFSRVA

SEQ ID NO: 1496 - protein, 25 aa, Corononavirus-HKU1
APSTSKPTQPLTRLMASSLVINNLE

SEQ ID NO: 1497 - protein, 50 aa, Corononavirus-HKU1
PSRVKSNLKPIRDIKREYVKTGSQIFKFTAKFSLTLYLSSTAKNEGACAG

SEQ ID NO: 1498 - protein, 21 aa, Corononavirus-HKU1
PKQLLLQSLKRLVVQCKRGKV

SEQ ID NO: 1499 - protein, 52 aa, Corononavirus-HKU1
ILSKGRVIKLRDSNNCILLITQKMPFLALVMATLNRLTLTEWAVSAVCEYIT

SEQ ID NO: 1500 - protein, 5 aa, Corononavirus-HKU1
SYSEP

SEQ ID NO: 1501 - protein, 7 aa, Corononavirus-HKU1
AESTVCV

SEQ ID NO: 1502 - protein, 8 aa, Corononavirus-HKU1
TPKTRLAT

SEQ ID NO: 1503 - protein, 23 aa, Corononavirus-HKU1
GLIKTALFQTGLAFKNLLIRYIC

SEQ ID NO: 1504 - protein, 33 aa, Corononavirus-HKU1
IFTALELSCVVCPLKYTLKHNELLSFLALSLLS

SEQ ID NO: 1505 - protein, 14 aa, Corononavirus-HKU1
TNAETVSTISLGHL

SEQ ID NO: 1506 - protein, 37 aa, Corononavirus-HKU1
QFPKKISGPKQHIILVIELKCLGSKEPLLNSTRGAGN

SEQ ID NO: 1507 - protein, 7 aa, Corononavirus-HKU1
AGSPIYT

SEQ ID NO: 1508 - protein, 13 aa, Corononavirus-HKU1
CLALIRAFITDNS

SEQ ID NO: 1509 - protein, 38 aa, Corononavirus-HKU1
LVSILTSSTTTISVTNSGNAFIVVKTYLQVVSLILNLS

SEQ ID NO: 1510 - protein, 20 aa, Corononavirus-HKU1
QSTRTLAGIIRVQSLIFKNL

SEQ ID NO: 1511 - protein, 10 aa, Corononavirus-HKU1
AFSHNASTAA

SEQ ID NO: 1512 - protein, 4 aa, Corononavirus-HKU1
LAAV

SEQ ID NO: 1513 - protein, 5 aa, Corononavirus-HKU1
TTRAV

SEQ ID NO: 1514 - protein, 7 aa, Corononavirus-HKU1
TARPIAR

SEQ ID NO: 1515 - protein, 8 aa, Corononavirus-HKU1
DFPVPGGP

SEQ ID NO: 1516 - protein, 6 aa, Corononavirus-HKU1
RFIPMC

SEQ ID NO: 1517 - protein, 5 aa, Corononavirus-HKU1
LATLF

SEQ ID NO: 1518 - protein, 6 aa, Corononavirus-HKU1
NTNGTL

SEQ ID NO: 1519 - protein, 8 aa, Corononavirus-HKU1
TLENLILA

SEQ ID NO: 1520 - protein, 28 aa, Corononavirus-HKU1
FSCGTSVGALKLATECDVKTKTSPIESL

SEQ ID NO: 1521 - protein, 5 aa, Corononavirus-HKU1
VVVAR

SEQ ID NO: 1522 - protein, 25 aa, Corononavirus-HKU1
YTPLVNSLLSKTYSPKTVLPVLVKW

SEQ ID NO: 1523 - protein, 4 aa, Corononavirus-HKU1
PVKT

SEQ ID NO: 1524 - protein, 24 aa, Corononavirus-HKU1
FLLSGGLTLPVSQHKITSLSLTIS

SEQ ID NO: 1525 - protein, 5 aa, Corononavirus-HKU1
MVAEA

SEQ ID NO: 1526 - protein, 10 aa, Corononavirus-HKU1
LCLKASSVAF

SEQ ID NO: 1527 - protein, 17 aa, Corononavirus-HKU1
VSAANNFKRSIHSFART

SEQ ID NO: 1528 - protein, 17 aa, Corononavirus-HKU1
SSTSVHLQLAILLKSSI

SEQ ID NO: 1529 - protein, 22 aa, Corononavirus-HKU1
GEPVQDCLYKPKTIPFITNLNE

SEQ ID NO: 1530 - protein, 7 aa, Corononavirus-HKU1
WGLWFSQ

SEQ ID NO: 1531 - protein, 21 aa, Corononavirus-HKU1
DIPPKYNLVTSLTSQLGALQT

SEQ ID NO: 1532 - protein, 8 aa, Corononavirus-HKU1
GETLKTYL

SEQ ID NO: 1533 - protein, 7 aa, Corononavirus-HKU1
LVAITWS

SEQ ID NO: 1534 - protein, 41 aa, Corononavirus-HKU1
QHLQHNKGLRIQLPQRKEVCDEQTTHAPTLCITALFKYIFL

SEQ ID NO: 1535 - protein, 17 aa, Corononavirus-HKU1
NDSSVNFKPSQVLKITL

SEQ ID NO: 1536 - protein, 4 aa, Corononavirus-HKU1
LSKI

SEQ ID NO: 1537 - protein, 25 aa, Corononavirus-HKU1
VPRSLYSFFIYSKYTRKTFWYSSFS

SEQ ID NO: 1538 - protein, 4 aa, Corononavirus-HKU1
CTKG

SEQ ID NO: 1539 - protein, 38 aa, Corononavirus-HKU1
ASIARLTKRSIKRTLSVFNKSSTKQPAPKILEGSGYGK

SEQ ID NO: 1540 - protein, 15 aa, Corononavirus-HKU1
SPSILTNIVCWEQNS

SEQ ID NO: 1541 - protein, 20 aa, Corononavirus-HKU1
GPLVISFSTQHLDSDIKTLF

SEQ ID NO: 1542 - protein, 4 aa, Corononavirus-HKU1
YKTC

SEQ ID NO: 1543 - protein, 7 aa, Corononavirus-HKU1
KTLILAI

SEQ ID NO: 1544 - protein, 4 aa, Corononavirus-HKU1
PLLA

SEQ ID NO: 1545 - protein, 19 aa, Corononavirus-HKU1
QTTPSSLKIIILKCLHKNS

SEQ ID NO: 1546 - protein, 6 aa, Corononavirus-HKU1
YSLTNV

SEQ ID NO: 1547 - protein, 33 aa, Corononavirus-HKU1
TLEYKRFCKLRILKSSILWPLQAIREQTLAVTA

SEQ ID NO: 1548 - protein, 23 aa, Corononavirus-HKU1
HILKTELAKAVVASPLLVPPGLT

SEQ ID NO: 1549 - protein, 11 aa, Corononavirus-HKU1
QPPHITISLKT

SEQ ID NO: 1550 - protein, 7 aa, Corononavirus-HKU1
AHSFARR

SEQ ID NO: 1551 - protein, 33 aa, Corononavirus-HKU1
NLSPCEQQNSCLRAKTKLLTIRKIFGIARSHLG

SEQ ID NO: 1552 - protein, 14 aa, Corononavirus-HKU1
SQPIRTGLSTSFIR

SEQ ID NO: 1553 - protein, 8 aa, Corononavirus-HKU1
RNISSQPP

SEQ ID NO: 1554 - protein, 21 aa, Corononavirus-HKU1
NLVVPITTGTPRVAAILFKHF

SEQ ID NO: 1555 - protein, 31 aa, Corononavirus-HKU1
WNIRPVIVLRIETPATVRALFLALIAYFKFI

SEQ ID NO: 1556 - protein, 12 aa, Corononavirus-HKU1
VKVGRTLRLVYA

SEQ ID NO: 1557 - protein, 11 aa, Corononavirus-HKU1
ISFCSSNDNAS

SEQ ID NO: 1558 - protein, 10 aa, Corononavirus-HKU1
SLALPNLLNG

SEQ ID NO: 1559 - protein, 5 aa, Corononavirus-HKU1
PALLS

SEQ ID NO: 1560 - protein, 14 aa, Corononavirus-HKU1
LLTITCDAGIQPPS

SEQ ID NO: 1561 - protein, 5 aa, Corononavirus-HKU1
ISKYL

SEQ ID NO: 1562 - protein, 20 aa, Corononavirus-HKU1
TTSNTNNNCLISTIVGKLYL

SEQ ID NO: 1563 - protein, 8 aa, Corononavirus-HKU1
SVIAALPS

SEQ ID NO: 1564 - protein, 23 aa, Corononavirus-HKU1
VKKKCFKSTVLPSLNKPLLLTNS

SEQ ID NO: 1565 - protein, 11 aa, Corononavirus-HKU1
KSWLKLPGFTV

SEQ ID NO: 1566 - protein, 33 aa, Corononavirus-HKU1
NFIPLVMAATLKQQVRKSSRALADATCIAGSAA

SEQ ID NO: 1567 - protein, 9 aa, Corononavirus-HKU1
RSKSLRDKR

SEQ ID NO: 1568 - protein, 15 aa, Corononavirus-HKU1
RCVSTSKFITTPNSL

SEQ ID NO: 1569 - protein, 36 aa, Corononavirus-HKU1
PIETTNGTPSTKICLTRGPKQVLGKTILNSILKLAQ

SEQ ID NO: 1570 - protein, 13 aa, Corononavirus-HKU1
IIHLSLSQSTVLG

SEQ ID NO: 1571 - protein, 16 aa, Corononavirus-HKU1
YFIPQYLKYLLNNSNL

SEQ ID NO: 1572 - protein, 12 aa, Corononavirus-HKU1
SVKSYCTRSNCL

SEQ ID NO: 1573 - protein, 11 aa, Corononavirus-HKU1
LSLTNNSQSNT

SEQ ID NO: 1574 - protein, 8 aa, Corononavirus-HKU1
HIVNIGII

SEQ ID NO: 1575 - protein, 21 aa, Corononavirus-HKU1
ESATATPNPGAVCIKSPKSYH

SEQ ID NO: 1576 - protein, 58 aa, Corononavirus-HKU1
PYKSWLSKVKTPTKPTSTKVSAKMTVLSKALLKIGPNFLYILIISGFSTKSYQSFLEK

SEQ ID NO: 1577 - protein, 22 aa, Corononavirus-HKU1
DSLQSAYSQRISHNIEQSLRSK

SEQ ID NO: 1578 - protein, 41 aa, Corononavirus-HKU1
QRSNIVYFERFLRTICGTRLPSISNVKKSCSATTPQLLVNS

SEQ ID NO: 1579 - protein, 5 aa, Corononavirus-HKU1
VFSLL

SEQ ID NO: 1580 - protein, 22 aa, Corononavirus-HKU1
TSKLVLLTTKNLSNLLPSSSIR

SEQ ID NO: 1581 - protein, 7 aa, Corononavirus-HKU1
KRQQFTL

SEQ ID NO: 1582 - protein, 17 aa, Corononavirus-HKU1
YKPIPALLVLQMSNALN

SEQ ID NO: 1583 - protein, 28 aa, Corononavirus-HKU1
TSVDKPLAQGTSRAFTLVPRTRLKNLNL

SEQ ID NO: 1584 - protein, 31 aa, Corononavirus-HKU1
IEQRHLNLHRNNCHLSKNHRLDKHHVLTHKE

SEQ ID NO: 1585 - protein, 42 aa, Corononavirus-HKU1
DLLYPKGLVQIYHVIYIYHLHLDALHVHGNKYKLRHHHKNLG

SEQ ID NO: 1586 - protein, 12 aa, Corononavirus-HKU1
WPYQYQHDHRAF

SEQ ID NO: 1587 - protein, 13 aa, Corononavirus-HKU1
VHHLVVYNLNKFS

SEQ ID NO: 1588 - protein, 10 aa, Corononavirus-HKU1
DLQKMHIMKV

SEQ ID NO: 1589 - protein, 4 aa, Corononavirus-HKU1
LHTQ

SEQ ID NO: 1590 - protein, 6 aa, Corononavirus-HKU1
QHQPAI

SEQ ID NO: 1591 - protein, 11 aa, Corononavirus-HKU1
LLKIKYQQPTL

SEQ ID NO: 1592 - protein, 6 aa, Corononavirus-HKU1
LKCYIL

SEQ ID NO: 1593 - protein, 4 aa, Corononavirus-HKU1
NKDT

SEQ ID NO: 1594 - protein, 20 aa, Corononavirus-HKU1
KIYKEDQALKQHNFHHLSLS

SEQ ID NO: 1595 - protein, 5 aa, Corononavirus-HKU1
DHQHH

SEQ ID NO: 1596 - protein, 17 aa, Corononavirus-HKU1
EQHKLFYHYYHYYNNIE

SEQ ID NO: 1597 - protein, 10 aa, Corononavirus-HKU1
EYYNSYQNHY

SEQ ID NO: 1598 - protein, 15 aa, Corononavirus-HKU1
QLVFLIYEASTHYSA

SEQ ID NO: 1599 - protein, 8 aa, Corononavirus-HKU1
QLHYTCSQ

SEQ ID NO: 1600 - protein, 4 aa, Corononavirus-HKU1
QEAN

SEQ ID NO: 1601 - protein, 6 aa, Corononavirus-HKU1
YQLTVY

SEQ ID NO: 1602 - protein, 17 aa, Corononavirus-HKU1
YHQHLEQSVYAIHYQHM

SEQ ID NO: 1603 - protein, 17 aa, Corononavirus-HKU1
HKHYQQLYQKLVYLVLL

SEQ ID NO: 1604 - protein, 5 aa, Corononavirus-HKU1
QPMLE

SEQ ID NO: 1605 - protein, 7 aa, Corononavirus-HKU1
HSKVHNL

SEQ ID NO: 1606 - protein, 5 aa, Corononavirus-HKU1
QHYPE

SEQ ID NO: 1607 - protein, 12 aa, Corononavirus-HKU1
NLKPDYPIYEPC

SEQ ID NO: 1608 - protein, 15 aa, Corononavirus-HKU1
KALSAKRKQLYSSYH

SEQ ID NO: 1609 - protein, 7 aa, Corononavirus-HKU1
SEPLYTC

SEQ ID NO: 1610 - protein, 21 aa, Corononavirus-HKU1
VLGLPYVQVCELQLYHVHTQT

SEQ ID NO: 1611 - protein, 14 aa, Corononavirus-HKU1
LYYMLFLTVLSVVD

SEQ ID NO: 1612 - protein, 5 aa, Corononavirus-HKU1
QNHYF

SEQ ID NO: 1613 - protein, 14 aa, Corononavirus-HKU1
HQPNFSLRLHIQQN

SEQ ID NO: 1614 - protein, 21 aa, Corononavirus-HKU1
PYLQTHFAKPAKRYYLEHNHR

SEQ ID NO: 1615 - protein, 8 aa, Corononavirus-HKU1
LHLYLQDT

SEQ ID NO: 1616 - protein, 26 aa, Corononavirus-HKU1
YQLQQDWRIKQSIIEQAYQKLHSNLK

SEQ ID NO: 1617 - protein, 14 aa, Corononavirus-HKU1
IVFHYVKHYNTATT

SEQ ID NO: 1618 - protein, 14 aa, Corononavirus-HKU1
KQHANAVNNLTKQH

SEQ ID NO: 1619 - protein, 15 aa, Corononavirus-HKU1
HISHQSILIEFGRLQ

SEQ ID NO: 1620 - protein, 14 aa, Corononavirus-HKU1
LARHLFQAVLNLTK

SEQ ID NO: 1621 - protein, 11 aa, Corononavirus-HKU1
PQNYYEVDVSH

SEQ ID NO: 1622 - protein, 17 aa, Corononavirus-HKU1
HSYNAILEQKFYNYKHP

SEQ ID NO: 1623 - protein, 18 aa, Corononavirus-HKU1
KHCLKERKIPNNKIKYTL

SEQ ID NO: 1624 - protein, 8 aa, Corononavirus-HKU1
ISNSRESI

SEQ ID NO: 1625 - protein, 5 aa, Corononavirus-HKU1
YKVHL

SEQ ID NO: 1626 - protein, 4 aa, Corononavirus-HKU1
NKIY

SEQ ID NO: 1627 - protein, 4 aa, Corononavirus-HKU1
QTTN

SEQ ID NO: 1628 - protein, 5 aa, Corononavirus-HKU1
QQFLL

SEQ ID NO: 1629 - protein, 4 aa, Corononavirus-HKU1
LMTK

SEQ ID NO: 1630 - protein, 10 aa, Corononavirus-HKU1
WSMYKYLKRL

SEQ ID NO: 1631 - protein, 14 aa, Corononavirus-HKU1
ITKHPLLNSTQNTT

SEQ ID NO: 1632 - protein, 14 aa, Corononavirus-HKU1
LFYQPKTSKKKCHD

SEQ ID NO: 1633 - protein, 15 aa, Corononavirus-HKU1
QKHIKYNHKILHKHK

SEQ ID NO: 1634 - protein, 13 aa, Corononavirus-HKU1
NSQQEQNMRARHK

SEQ ID NO: 1635 - protein, 22 aa, Corononavirus-HKU1
NLPYKQLNNLHKTRYRVQELYT

SEQ ID NO: 1636 - protein, 7 aa, Corononavirus-HKU1
SNKNAYV

SEQ ID NO: 1637 - protein, 4 aa, Corononavirus-HKU1
LVTS

SEQ ID NO: 1638 - protein, 7 aa, Corononavirus-HKU1
QNKVHIM

SEQ ID NO: 1639 - protein, 6 aa, Corononavirus-HKU1
HQSYVY

SEQ ID NO: 1640 - protein, 7 aa, Corononavirus-HKU1
QMQKLYN

SEQ ID NO: 1641 - protein, 9 aa, Corononavirus-HKU1
ISKSNKLFL

SEQ ID NO: 1642 - protein, 4 aa, Corononavirus-HKU1
IFLF

SEQ ID NO: 1643 - protein, 33 aa, Corononavirus-HKU1
HQPIVDKRQKVPIHLQKYNFLVFDDLEIPYIDA

SEQ ID NO: 1644 - protein, 6 aa, Corononavirus-HKU1
QPIKFQ

SEQ ID NO: 1645 - protein, 18 aa, Corononavirus-HKU1
KHLSLKPKHLRQDLLLLG

SEQ ID NO: 1646 - protein, 4 aa, Corononavirus-HKU1
NHLP

SEQ ID NO: 1647 - protein, 12 aa, Corononavirus-HKU1
NKHHFVQTKHNY

SEQ ID NO: 1648 - protein, 6 aa, Corononavirus-HKU1
LHRAKQ

SEQ ID NO: 1649 - protein, 6 aa, Corononavirus-HKU1
QSGRSP

SEQ ID NO: 1650 - protein, 17 aa, Corononavirus-HKU1
LATVQLEHLYMDHKNYQ

SEQ ID NO: 1651 - protein, 9 aa, Corononavirus-HKU1
NQCQCDNQY

SEQ ID NO: 1652 - protein, 9 aa, Corononavirus-HKU1
ALIDAYIQT

SEQ ID NO: 1653 - protein, 20 aa, Corononavirus-HKU1
HYHLLIHNQQIHMTHTKKNL

SEQ ID NO: 1654 - protein, 5 aa, Corononavirus-HKU1
YNYYA

SEQ ID NO: 1655 - protein, 15 aa, Corononavirus-HKU1
HEMPLVVGHYTQLKQ

SEQ ID NO: 1656 - protein, 5 aa, Corononavirus-HKU1
KFHQV

SEQ ID NO: 1657 - protein, 38 aa, Corononavirus-HKU1
HYQKYILECKDFVKRLSKQVDSPASGKTQLLNSSDQTL

SEQ ID NO: 1658 - protein, 4 aa, Corononavirus-HKU1
NHLE

SEQ ID NO: 1659 - protein, 13 aa, Corononavirus-HKU1
LYTIRQNNQVRSY

SEQ ID NO: 1660 - protein, 4 aa, Corononavirus-HKU1
RMNI

SEQ ID NO: 1661 - protein, 21 aa, Corononavirus-HKU1
HDEDNKLCHLTINHSKSYYHK

SEQ ID NO: 1662 - protein, 8 aa, Corononavirus-HKU1
QYKVQFLT

SEQ ID NO: 1663 - protein, 13 aa, Corononavirus-HKU1
EIPSLQYLIAKKM

SEQ ID NO: 1664 - protein, 4 aa, Corononavirus-HKU1
KQML

SEQ ID NO: 1665 - protein, 12 aa, Corononavirus-HKU1
EVGIRHHYHYCD

SEQ ID NO: 1666 - protein, 46 aa, Corononavirus-HKU1
LTENTPLLYRQQYPFYHYSNDTYYTNSNIYCRQHQKQNSLIYNKNL

SEQ ID NO: 1667 - protein, 12 aa, Corononavirus-HKU1
EMFLQMYYHYIH

SEQ ID NO: 1668 - protein, 16 aa, Corononavirus-HKU1
HQFSYNMKITIKHGLQ

SEQ ID NO: 1669 - protein, 7 aa, Corononavirus-HKU1
HKTKKAL

SEQ ID NO: 1670 - protein, 6 aa, Corononavirus-HKU1
QSIANA

SEQ ID NO: 1671 - protein, 20 aa, Corononavirus-HKU1
FQKENTMLHKNKNKHKHMHK

SEQ ID NO: 1672 - protein, 8 aa, Corononavirus-HKU1
DKLEKQKA

SEQ ID NO: 1673 - protein, 7 aa, Corononavirus-HKU1
YTKQQHL

SEQ ID NO: 1674 - protein, 7 aa, Corononavirus-HKU1
YNLQKHA

SEQ ID NO: 1675 - protein, 12 aa, Corononavirus-HKU1
VLLNNKKPRQQL

SEQ ID NO: 1676 - protein, 5 aa, Corononavirus-HKU1
EKRNL

SEQ ID NO: 1677 - protein, 5 aa, Corononavirus-HKU1
DELNY

SEQ ID NO: 1678 - protein, 30 aa, Corononavirus-HKU1
KIDKTNQKDLYHKKFQAYFYNNHYSKPRNY

SEQ ID NO: 1679 - protein, 17 aa, Corononavirus-HKU1
NIYPLRRIHMHPLYNKS

SEQ ID NO: 1680 - protein, 11 aa, Corononavirus-HKU1
SAFLQYVQYLH

SEQ ID NO: 1681 - protein, 5 aa, Corononavirus-HKU1
HQEIL

SEQ ID NO: 1682 - protein, 18 aa, Corononavirus-HKU1
QGYNVYVEPKMYTKKHSS

SEQ ID NO: 1683 - protein, 15 aa, Corononavirus-HKU1
HHLNNNKDVVYHHLF

SEQ ID NO: 1684 - protein, 9 aa, Corononavirus-HKU1
YTKMIKHNH

SEQ ID NO: 1685 - protein, 19 aa, Corononavirus-HKU1
HKNHYKKSEYVVYSTEHYH

SEQ ID NO: 1686 - protein, 17 aa, Corononavirus-HKU1
QMHKLKNVKHESHVSKL

SEQ ID NO: 1687 - protein, 6 aa, Corononavirus-HKU1
NRYLHP

SEQ ID NO: 1688 - protein, 4 aa, Corononavirus-HKU1
LPLQ

SEQ ID NO: 1689 - protein, 21 aa, Corononavirus-HKU1
NYDSKQTQKWTHTIDQIGKIY

SEQ ID NO: 1690 - protein, 5 aa, Corononavirus-HKU1
QNINH

SEQ ID NO: 1691 - protein, 4 aa, Corononavirus-HKU1
LKYL

SEQ ID NO: 1692 - protein, 5 aa, Corononavirus-HKU1
QHHYQ

SEQ ID NO: 1693 - protein, 14 aa, Corononavirus-HKU1
HKQANEYQTYKHYM

SEQ ID NO: 1694 - protein, 7 aa, Corononavirus-HKU1
AIKPTII

SEQ ID NO: 1695 - protein, 4 aa, Corononavirus-HKU1
NRLN

SEQ ID NO: 1696 - protein, 15 aa, Corononavirus-HKU1
QKIIYITNYSIQHLL

SEQ ID NO: 1697 - protein, 5 aa, Corononavirus-HKU1
VKRVL

SEQ ID NO: 1698 - protein, 7 aa, Corononavirus-HKU1
GHLPLAY

SEQ ID NO: 1699 - protein, 9 aa, Corononavirus-HKU1
KSILTSSQF

SEQ ID NO: 1700 - protein, 12 aa, Corononavirus-HKU1
HMLFLIYAVNQQ

SEQ ID NO: 1701 - protein, 6 aa, Corononavirus-HKU1
TIYKKY

SEQ ID NO: 1702 - protein, 7 aa, Corononavirus-HKU1
QHYPVHA

SEQ ID NO: 1703 - protein, 4 aa, Corononavirus-HKU1
HHSV

SEQ ID NO: 1704 - protein, 15 aa, Corononavirus-HKU1
EHLNQQLQYYHSLNM

SEQ ID NO: 1705 - protein, 9 aa, Corononavirus-HKU1
VPNCYNFHQ

SEQ ID NO: 1706 - protein, 10 aa, Corononavirus-HKU1
IPNQQLLQIS

SEQ ID NO: 1707 - protein, 30 aa, Corononavirus-HKU1
ILFQHLNQWNNIYVHIPQKYLKPFLIAHPL

SEQ ID NO: 1708 - protein, 6 aa, Corononavirus-HKU1
EKHEQC

SEQ ID NO: 1709 - protein, 10 aa, Corononavirus-HKU1
NSFYQHQNET

SEQ ID NO: 1710 - protein, 8 aa, Corononavirus-HKU1
KYQHKHQT

SEQ ID NO: 1711 - protein, 10 aa, Corononavirus-HKU1
SGLQRYHYKL

SEQ ID NO: 1712 - protein, 8 aa, Corononavirus-HKU1
LTFCLQVI

SEQ ID NO: 1713 - protein, 15 aa, Corononavirus-HKU1
AYTMIVHKTQQHSEN

SEQ ID NO: 1714 - protein, 13 aa, Corononavirus-HKU1
LYQHHSLLQLHTN

SEQ ID NO: 1715 - protein, 5 aa, Corononavirus-HKU1
NVTDY

SEQ ID NO: 1716 - protein, 5 aa, Corononavirus-HKU1
YLQIN

SEQ ID NO: 1717 - protein, 23 aa, Corononavirus-HKU1
HQHHRKHAVHLYHRTNASYNQLA

SEQ ID NO: 1718 - protein, 13 aa, Corononavirus-HKU1
LHNVKHQLDLQVV

SEQ ID NO: 1719 - protein, 5 aa, Corononavirus-HKU1
QLLQL

SEQ ID NO: 1720 - protein, 5 aa, Corononavirus-HKU1
KCYLV

SEQ ID NO: 1721 - protein, 4 aa, Corononavirus-HKU1
KNGN

SEQ ID NO: 1722 - protein, 6 aa, Corononavirus-HKU1
NNSIDV

SEQ ID NO: 1723 - protein, 7 aa, Corononavirus-HKU1
HKNQYHH

SEQ ID NO: 1724 - protein, 10 aa, Corononavirus-HKU1
YHNNELHHQQ

SEQ ID NO: 1725 - protein, 23 aa, Corononavirus-HKU1
HEHYNFVYNKINNQLYYNHRQYA

SEQ ID NO: 1726 - protein, 6 aa, Corononavirus-HKU1
NQLLYT

SEQ ID NO: 1727 - protein, 14 aa, Corononavirus-HKU1
QLYKTATRQKQVTY

SEQ ID NO: 1728 - protein, 4 aa, Corononavirus-HKU1
LQIQ

SEQ ID NO: 1729 - protein, 4 aa, Corononavirus-HKU1
STNA

SEQ ID NO: 1730 - protein, 6 aa, Corononavirus-HKU1
TNQATM

SEQ ID NO: 1731 - protein, 5 aa, Corononavirus-HKU1
IIVNQ

SEQ ID NO: 1732 - protein, 15 aa, Corononavirus-HKU1
DKIMDKTILCIMNNQ

SEQ ID NO: 1733 - protein, 6 aa, Corononavirus-HKU1
RVQQLI

SEQ ID NO: 1734 - protein, 16 aa, Corononavirus-HKU1
HNQIKHVYLLHTEQNL

SEQ ID NO: 1735 - protein, 16 aa, Corononavirus-HKU1
LHMYPTYQNQNDTIHI

SEQ ID NO: 1736 - protein, 8 aa, Corononavirus-HKU1
NYHYKNDL

SEQ ID NO: 1737 - protein, 5 aa, Corononavirus-HKU1
NLHLT

SEQ ID NO: 1738 - protein, 6 aa, Corononavirus-HKU1
NKNHKL

SEQ ID NO: 1739 - protein, 4 aa, Corononavirus-HKU1
PNQK

SEQ ID NO: 1740 - protein, 4 aa, Corononavirus-HKU1
PLST

SEQ ID NO: 1741 - protein, 6 aa, Corononavirus-HKU1
QFFPQK

SEQ ID NO: 1742 - protein, 5 aa, Corononavirus-HKU1
EDKSH

SEQ ID NO: 1743 - protein, 6 aa, Corononavirus-HKU1
HLYTKN

SEQ ID NO: 1744 - protein, 14 aa, Corononavirus-HKU1
TKTKTQWLQQENLL

SEQ ID NO: 1745 - protein, 4 aa, Corononavirus-HKU1
IYSI

SEQ ID NO: 1746 - protein, 6 aa, Corononavirus-HKU1
MSEKHF

SEQ ID NO: 1747 - protein, 6 aa, Corononavirus-HKU1
EPNKTN

SEQ ID NO: 1748 - protein, 4 aa, Corononavirus-HKU1
KLFL

SEQ ID NO: 1749 - protein, 8 aa, Corononavirus-HKU1
YKKWFYHL

SEQ ID NO: 1750 - protein, 4 aa, Corononavirus-HKU1
NVIN

SEQ ID NO: 1751 - protein, 10 aa, Corononavirus-HKU1
TTTSKNHKIL

SEQ ID NO: 1752 - protein, 15 aa, Corononavirus-HKU1
ELKEFDYHLLNITNL

SEQ ID NO: 1753 - protein, 7 aa, Corononavirus-HKU1
YHIVYIP

SEQ ID NO: 1754 - protein, 4 aa, Corononavirus-HKU1
LLVI

SEQ ID NO: 1755 - protein, 6 aa, Corononavirus-HKU1
LGVTIH

SEQ ID NO: 1756 - protein, 22 aa, Corononavirus-HKU1
QPKQHNHNLSNTYPKHQLKINF

SEQ ID NO: 1757 - protein, 5 aa, Corononavirus-HKU1
NYFHH

SEQ ID NO: 1758 - protein, 4 aa, Corononavirus-HKU1
HLLF

SEQ ID NO: 1759 - protein, 4 aa, Corononavirus-HKU1
HPLT

SEQ ID NO: 1760 - protein, 4 aa, Corononavirus-HKU1
SAIP

SEQ ID NO: 1761 - protein, 22 aa, Corononavirus-HKU1
PHYLVTPQIQNQQTKHYIYFQI

SEQ ID NO: 1762 - protein, 12 aa, Corononavirus-HKU1
ENSMMLHHDKTK

SEQ ID NO: 1763 - protein, 9 aa, Corononavirus-HKU1
QAYQKFHIL

SEQ ID NO: 1764 - protein, 16 aa, Corononavirus-HKU1
NNVSHINHQMPKQHHQ

SEQ ID NO: 1765 - protein, 16 aa, Corononavirus-HKU1
LQARLLLCTQQTANLH

SEQ ID NO: 1766 - protein, 16 aa, Corononavirus-HKU1
NLTYHSIEHKYHVQLT

SEQ ID NO: 1767 - protein, 6 aa, Corononavirus-HKU1
YKHRQL

SEQ ID NO: 1768 - protein, 4 aa, Corononavirus-HKU1
TEPL

SEQ ID NO: 1769 - protein, 29 aa, Corononavirus-HKU1
VLYNTYHYHNNIVKDQGYKQPFQHHPKNN

SEQ ID NO: 1770 - protein, 6 aa, Corononavirus-HKU1
KSGLNF

SEQ ID NO: 1771 - protein, 9 aa, Corononavirus-HKU1
DTSSQLNNH

SEQ ID NO: 1772 - protein, 5 aa, Corononavirus-HKU1
HLYIF

SEQ ID NO: 1773 - protein, 24 aa, Corononavirus-HKU1
HYKHHNVGKVNHISNVYNGLHLHP

SEQ ID NO: 1774 - protein, 14 aa, Corononavirus-HKU1
LQQHHQVNPYSEEY

SEQ ID NO: 1775 - protein, 9 aa, Corononavirus-HKU1
NKSKMVHSI

SEQ ID NO: 1776 - protein, 16 aa, Corononavirus-HKU1
YNGQFYLHNYSQSYNH

SEQ ID NO: 1777 - protein, 11 aa, Corononavirus-HKU1
KDQSLLMYQNA

SEQ ID NO: 1778 - protein, 10 aa, Corononavirus-HKU1
QHQHQHDFLV

SEQ ID NO: 1779 - protein, 5 aa, Corononavirus-HKU1
YHNHK

SEQ ID NO: 1780 - protein, 18 aa, Corononavirus-HKU1
VLIHKLHLINQLVSKQHE

SEQ ID NO: 1781 - protein, 7 aa, Corononavirus-HKU1
HLMVHQI

SEQ ID NO: 1782 - protein, 25 aa, Corononavirus-HKU1
LKQEQLTYVVCQHEIHTMLPATAIY

SEQ ID NO: 1783 - protein, 4 aa, Corononavirus-HKU1
YAAT

SEQ ID NO: 1784 - protein, 20 aa, Corononavirus-HKU1
DKLHSHNNYYETVQKKKMDR

SEQ ID NO: 1785 - protein, 53 aa, Corononavirus-HKU1
QLQTIYILLKNYNKQAIVADQTQMNFVQQKYQLKTNFHTDIKFYRHKNHYTLT

SEQ ID NO: 1786 - protein, 19 aa, Corononavirus-HKU1
HQCHHRKHYQVFYQKLHLQ

SEQ ID NO: 1787 - protein, 4 aa, Corononavirus-HKU1
HHLQ

SEQ ID NO: 1788 - protein, 6 aa, Corononavirus-HKU1
AKHLSS

SEQ ID NO: 1789 - protein, 7 aa, Corononavirus-HKU1
LIKHKLD

SEQ ID NO: 1790 - protein, 22 aa, Corononavirus-HKU1
QLLYKKNHHIHNQSLYPDYIYK

SEQ ID NO: 1791 - protein, 5 aa, Corononavirus-HKU1
DTQNT

SEQ ID NO: 1792 - protein, 4 aa, Corononavirus-HKU1
HQIY

SEQ ID NO: 1793 - protein, 4 aa, Corononavirus-HKU1
DANL

SEQ ID NO: 1794 - protein, 22 aa, Corononavirus-HKU1
TTNNHERHYSIVYHDEAIKLLV

SEQ ID NO: 1795 - protein, 22 aa, Corononavirus-HKU1
QKNLKQNNHHHSKKVCMHLSQI

SEQ ID NO: 1796 - protein, 4 aa, Corononavirus-HKU1
HGLH

SEQ ID NO: 1797 - protein, 4 aa, Corononavirus-HKU1
QPML

SEQ ID NO: 1798 - protein, 5 aa, Corononavirus-HKU1
YQQLK

SEQ ID NO: 1799 - protein, 5 aa, Corononavirus-HKU1
FDIFE

SEQ ID NO: 1800 - protein, 8 aa, Corononavirus-HKU1
YQNLLYYY

SEQ ID NO: 1801 - protein, 18 aa, Corononavirus-HKU1
LVYQQHLEGKLMTHQQEH

SEQ ID NO: 1802 - protein, 5 aa, Corononavirus-HKU1
IYQPI

SEQ ID NO: 1803 - protein, 7 aa, Corononavirus-HKU1
TNNNHNY

SEQ ID NO: 1804 - protein, 17 aa, Corononavirus-HKU1
DAYKHVLTKHKIVFHLV

SEQ ID NO: 1805 - protein, 6 aa, Corononavirus-HKU1
HQGLQY

SEQ ID NO: 1806 - protein, 9 aa, Corononavirus-HKU1
ELFYIIYHR

SEQ ID NO: 1807 - protein, 11 aa, Corononavirus-HKU1
KHNNLLLGKHL

SEQ ID NO: 1808 - protein, 4 aa, Corononavirus-HKU1
QQFL

SEQ ID NO: 1809 - protein, 9 aa, Corononavirus-HKU1
KIFYLQLQL

SEQ ID NO: 1810 - protein, 12 aa, Corononavirus-HKU1
LLQLHHHGAYAH

SEQ ID NO: 1811 - protein, 4 aa, Corononavirus-HKU1
QNIH

SEQ ID NO: 1812 - protein, 16 aa, Corononavirus-HKU1
VLYTNHTIEVTQKKTY

SEQ ID NO: 1813 - protein, 7 aa, Corononavirus-HKU1
MTFHNLL

SEQ ID NO: 1814 - protein, 6 aa, Corononavirus-HKU1
NQIYHH

SEQ ID NO: 1815 - protein, 10 aa, Corononavirus-HKU1
QTYHLFVHHL

SEQ ID NO: 1816 - protein, 15 aa, Corononavirus-HKU1
QLQNDKRLHPQHMQQ

SEQ ID NO: 1817 - protein, 61 aa, Corononavirus-HKU1
GCKKHKNCHQIMKNVMYKVSPLLLESYYVHTYKHETQYLHKKTKHPNHLNQKKNHILNNTN

SEQ ID NO: 1818 - protein, 21 aa, Corononavirus-HKU1
YQTGLKTNKQNQLQNHLEAKQ

SEQ ID NO: 1819 - protein, 22 aa, Corononavirus-HKU1
WSVNNQQNFDYNPPYKITTYFQ

SEQ ID NO: 1820 - protein, 15 aa, Corononavirus-HKU1
KVISALQVTQNATNN

SEQ ID NO: 1821 - protein, 5 aa, Corononavirus-HKU1
VTINH

SEQ ID NO: 1822 - protein, 7 aa, Corononavirus-HKU1
NMFLFQH

SEQ ID NO: 1823 - protein, 9 aa, Corononavirus-HKU1
QTKHHYRHH

SEQ ID NO: 1824 - protein, 22 aa, Corononavirus-HKU1
KLKELYKYQSHKYFQYHLHHHQ

SEQ ID NO: 1825 - protein, 9 aa, Corononavirus-HKU1
QQFGHHCHQ

SEQ ID NO: 1826 - protein, 9 aa, Corononavirus-HKU1
QSLHRYCHQ

SEQ ID NO: 1827 - protein, 9 aa, Corononavirus-HKU1
QHLHRHCHQ

SEQ ID NO: 1828 - protein, 9 aa, Corononavirus-HKU1
QHLHRHCHQ

SEQ ID NO: 1829 - protein, 9 aa, Corononavirus-HKU1
QHLHRHCHQ

SEQ ID NO: 1830 - protein, 9 aa, Corononavirus-HKU1
QHLHRHCHQ

SEQ ID NO: 1831 - protein, 9 aa, Corononavirus-HKU1
QHLHRHCHQ

SEQ ID NO: 1832 - protein, 9 aa, Corononavirus-HKU1
QHLHRHCHQ

SEQ ID NO: 1833 - protein, 9 aa, Corononavirus-HKU1
QHLHRHCHQ

SEQ ID NO: 1834 - protein, 9 aa, Corononavirus-HKU1
QHLHRHCHQ

SEQ ID NO: 1835 - protein, 9 aa, Corononavirus-HKU1
QHLHRHCHQ

SEQ ID NO: 1836 - protein, 9 aa, Corononavirus-HKU1
QHLHRHCHQ

SEQ ID NO: 1837 - protein, 9 aa, Corononavirus-HKU1
QHLHRHCHQ

SEQ ID NO: 1838 - protein, 9 aa, Corononavirus-HKU1
QHLHRHCHQ

SEQ ID NO: 1839 - protein, 9 aa, Corononavirus-HKU1
QHLHRHCHQ

SEQ ID NO: 1840 - protein, 6 aa, Corononavirus-HKU1
QHLHRH

SEQ ID NO: 1841 - protein, 7 aa, Corononavirus-HKU1
CLQRHHQ

SEQ ID NO: 1842 - protein, 7 aa, Corononavirus-HKU1
YLRQLHY

SEQ ID NO: 1843 - protein, 6 aa, Corononavirus-HKU1
RLQHPQ

SEQ ID NO: 1844 - protein, 24 aa, Corononavirus-HKU1
QKYNTYERPLLHHQPHQINKQHSH

SEQ ID NO: 1845 - protein, 24 aa, Corononavirus-HKU1
VYLKMHELDNQPLDALYKSLKHSL

SEQ ID NO: 1846 - protein, 11 aa, Corononavirus-HKU1
HHKQQQQNHLQ

SEQ ID NO: 1847 - protein, 18 aa, Corononavirus-HKU1
HPFLLQILNKLYLKYHQK

SEQ ID NO: 1848 - protein, 5 aa, Corononavirus-HKU1
NLNQT

SEQ ID NO: 1849 - protein, 8 aa, Corononavirus-HKU1
LSSKTESP

SEQ ID NO: 1850 - protein, 5 aa, Corononavirus-HKU1
QQVSR

SEQ ID NO: 1851 - protein, 21 aa, Corononavirus-HKU1
LFYLHMENAKPDLKDKYFYHS

SEQ ID NO: 1852 - protein, 14 aa, Corononavirus-HKU1
GKIYHHTYPCTYYL

SEQ ID NO: 1853 - protein, 7 aa, Corononavirus-HKU1
YKFFLQI

SEQ ID NO: 1854 - protein, 12 aa, Corononavirus-HKU1
VVDNTHKMIKKI

SEQ ID NO: 1855 - protein, 5 aa, Corononavirus-HKU1
HHLLL

SEQ ID NO: 1856 - protein, 28 aa, Corononavirus-HKU1
QILQRLQKNKFVVPVHYMVKQNQELTLY

SEQ ID NO: 1857 - protein, 13 aa, Corononavirus-HKU1
RYKTYCLQYKLNH

SEQ ID NO: 1858 - protein, 10 aa, Corononavirus-HKU1
EQAYLLKHQL

SEQ ID NO: 1859 - protein, 6 aa, Corononavirus-HKU1
HTLIIT

SEQ ID NO: 1860 - protein, 6 aa, Corononavirus-HKU1
KKCKIY

SEQ ID NO: 1861 - protein, 9 aa, Corononavirus-HKU1
HNQVLKQQN

SEQ ID NO: 1862 - protein, 19 aa, Corononavirus-HKU1
SWLEILQKDHSIIGKEASL

SEQ ID NO: 1863 - protein, 5 aa, Corononavirus-HKU1
HLTWY

SEQ ID NO: 1864 - protein, 4 aa, Corononavirus-HKU1
YPIT

SEQ ID NO: 1865 - protein, 7 aa, Corononavirus-HKU1
HNALYKM

SEQ ID NO: 1866 - protein, 6 aa, Corononavirus-HKU1
QLKLCP

SEQ ID NO: 1867 - protein, 21 aa, Corononavirus-HKU1
TKYTFLNTYQKLLVKIETSKM

SEQ ID NO: 1868 - protein, 38 aa, Corononavirus-HKU1
RKYHSELDNNYGELNHLVKKVQNHLHKLQTCKQNQHDA

SEQ ID NO: 1869 - protein, 15 aa, Corononavirus-HKU1
QTSQYFLEAYYNHLY

SEQ ID NO: 1870 - protein, 9 aa, Corononavirus-HKU1
ATVAYTKNY

SEQ ID NO: 1871 - protein, 23 aa, Corononavirus-HKU1
RQEYDFVQDYHTYIEHNLSKVHE

SEQ ID NO: 1872 - protein, 4 aa, Corononavirus-HKU1
EQFL

SEQ ID NO: 1873 - protein, 15 aa, Corononavirus-HKU1
IYNLLHLNKPNHHKT

SEQ ID NO: 1874 - protein, 17 aa, Corononavirus-HKU1
ESTIQDAATNIYKNQMV

SEQ ID NO: 1875 - protein, 6 aa, Corononavirus-HKU1
QNNHTN

SEQ ID NO: 1876 - protein, 4 aa, Corononavirus-HKU1
KNHG

SEQ ID NO: 1877 - protein, 5 aa, Corononavirus-HKU1
QYQYY

SEQ ID NO: 1878 - protein, 7 aa, Corononavirus-HKU1
ITQDFQE

SEQ ID NO: 1879 - protein, 6 aa, Corononavirus-HKU1
HQMIGL

SEQ ID NO: 1880 - protein, 28 aa, Corononavirus-HKU1
SHKLYNTMDKKNHPSYYLKPNHKNHNYH

SEQ ID NO: 1881 - protein, 8 aa, Corononavirus-HKU1
NNLHNHTA

SEQ ID NO: 1882 - protein, 11 aa, Corononavirus-HKU1
QNHNHTNQHYI

SEQ ID NO: 1883 - protein, 7 aa, Corononavirus-HKU1
KNHPYES

SEQ ID NO: 1884 - protein, 4 aa, Corononavirus-HKU1
LSSN

SEQ ID NO: 1885 - protein, 17 aa, Corononavirus-HKU1
EALKLLHQQIINVQVHV

SEQ ID NO: 1886 - protein, 9 aa, Corononavirus-HKU1
LHLHLLHLL

SEQ ID NO: 1887 - protein, 5 aa, Corononavirus-HKU1
VVQHI

SEQ ID NO: 1888 - protein, 4 aa, Corononavirus-HKU1
SAGA

SEQ ID NO: 1889 - protein, 59 aa, Corononavirus-HKU1
QIVNHELHAKPLQYQSHNWQAIQTAFVSYLAKNNDHKLEDNLLIYQNSHNHTGLQKVRV

SEQ ID NO: 1890 - protein, 5 aa, Corononavirus-HKU1
YHDIV

SEQ ID NO: 1891 - protein, 11 aa, Corononavirus-HKU1
VKHKLFVNIYL

SEQ ID NO: 1892 - protein, 12 aa, Corononavirus-HKU1
AQHEPQHKHLLH

SEQ ID NO: 1893 - protein, 6 aa, Corononavirus-HKU1
NHNHQI

SEQ ID NO: 1894 - protein, 25 aa, Corononavirus-HKU1
NLKLLNHSLQYTTYRIETICEHKMA

SEQ ID NO: 1895 - protein, 14 aa, Corononavirus-HKU1
NQKVQSNPKNLHQN

SEQ ID NO: 1896 - protein, 8 aa, Corononavirus-HKU1
KDDVQHNV

SEQ ID NO: 1897 - protein, 8 aa, Corononavirus-HKU1
SCMNGTSP

SEQ ID NO: 1898 - protein, 10 aa, Corononavirus-HKU1
ENHPSYAKVI

SEQ ID NO: 1899 - protein, 11 aa, Corononavirus-HKU1
LKLPYRTLRLF

SEQ ID NO: 1900 - protein, 16 aa, Corononavirus-HKU1
LELLQHVDLHEQKYHG

SEQ ID NO: 1901 - protein, 33 aa, Corononavirus-HKU1
DLTAHAILVQECSDNLSSHDYHKRIQHFPSLDQ

SEQ ID NO: 1902 - protein, 10 aa, Corononavirus-HKU1
RGITHPHLTS

SEQ ID NO: 1903 - protein, 17 aa, Corononavirus-HKU1
PTPPLHPEAANEILAPT

SEQ ID NO: 1904 - protein, 8 aa, Corononavirus-HKU1
SRDRICWF

SEQ ID NO: 1905 - protein, 19 aa, Corononavirus-HKU1
SLRPMGGTLRTTNTSLAER

SEQ ID NO: 1906 - protein, 24 aa, Corononavirus-HKU1
KVWKVKYKIMIKPHSQAWITGNLV

SEQ ID NO: 1907 - protein, 18 aa, Corononavirus-HKU1
DLTRDRKLIDGTDAIRSY

SEQ ID NO: 1908 - DNA, 29942 bp, Corononavirus-HKU1; identical to SEQ ID NO: 1319
  CDS (2)..(29941)

SEQ ID NO: 1909 - protein, 13 aa, Corononavirus-HKU1
FFFFFVIPPKGYN

SEQ ID NO: 1910 - protein, 13 aa, Corononavirus-HKU1
FQSYTNIYIKHYN

SEQ ID NO: 1911 - protein, 30 aa, Corononavirus-HKU1
LFPEAFILQLNLITTLTIKCLNIKFLLINI

SEQ ID NO: 1912 - protein, 15 aa, Corononavirus-HKU1
SVTTYSICYYSKNSF

SEQ ID NO: 1913 - protein, 6 aa, Corononavirus-HKU1
RVSYSE

SEQ ID NO: 1914 - protein, 5 aa, Corononavirus-HKU1
RGVTT

SEQ ID NO: 1915 - protein, 8 aa, Corononavirus-HKU1
CRIRIHSH

SEQ ID NO: 1916 - protein, 6 aa, Corononavirus-HKU1
ATESST

SEQ ID NO: 1917 - protein, 9 aa, Corononavirus-HKU1
GSSRVASKL

SEQ ID NO: 1918 - protein, 10 aa, Corononavirus-HKU1
SSGVKSFEMC

SEQ ID NO: 1919 - protein, 21 aa, Corononavirus-HKU1
VPALKLRESNCSGNCLTPLLR

SEQ ID NO: 1920 - protein, 11 aa, Corononavirus-HKU1
GLELNESESVF

SEQ ID NO: 1921 - protein, 4 aa, Corononavirus-HKU1
LELT

SEQ ID NO: 1922 - protein, 26 aa, Corononavirus-HKU1
AFKFSSRTFIIVSKPGKVLSNLIEPE

SEQ ID NO: 1923 - protein, 39 aa, Corononavirus-HKU1
SSKTSLTGESASESLLTKSNLEPKKKAPGVGANSARIGN

SEQ ID NO: 1924 - protein, 15 aa, Corononavirus-HKU1
GSLVPSFNISALPKF

SEQ ID NO: 1925 - protein, 9 aa, Corononavirus-HKU1
EGPLLPKHC

SEQ ID NO: 1926 - protein, 30 aa, Corononavirus-HKU1
TLQCLLGVRFWRGFVKILCLISLAFCLVTC

SEQ ID NO: 1927 - protein, 45 aa, Corononavirus-HKU1
GLESLPSLAKTRLAISSAISGFTIESECLKLELLLLNERLLGPRD

SEQ ID NO: 1928 - protein, 17 aa, Corononavirus-HKU1
EREPGRLLEADLPEPST

SEQ ID NO: 1929 - protein, 14 aa, Corononavirus-HKU1
GKIVPGGNLVGIAS

SEQ ID NO: 1930 - protein, 17 aa, Corononavirus-HKU1
VVGSLDETSEGVEVSAW

SEQ ID NO: 1931 - protein, 12 aa, Corononavirus-HKU1
LATQKTPSRDSP

SEQ ID NO: 1932 - protein, 10 aa, Corononavirus-HKU1
DALAYGPVPR

SEQ ID NO: 1933 - protein, 10 aa, Corononavirus-HKU1
KYHLGNNCFC

SEQ ID NO: 1934 - protein, 30 aa, Corononavirus-HKU1
PSAVLKERRLCLYQYPFASEGGTPKAMGTP

SEQ ID NO: 1935 - protein, 10 aa, Corononavirus-HKU1
PSENLKSLPF

SEQ ID NO: 1936 - protein, 7 aa, Corononavirus-HKU1
VIPENQE

SEQ ID NO: 1937 - protein, 8 aa, Corononavirus-HKU1
CGIVFPCG

SEQ ID NO: 1938 - protein, 17 aa, Corononavirus-HKU1
VDTVNLGWVFLPLLKVW

SEQ ID NO: 1939 - protein, 26 aa, Corononavirus-HKU1
FRSDWSAQEVFLRIPERFPEELLLPA

SEQ ID NO: 1940 - protein, 5 aa, Corononavirus-HKU1
DILIV

SEQ ID NO: 1941 - protein, 17 aa, Corononavirus-HKU1
ALNKAVSIPLGLLDGKR

SEQ ID NO: 1942 - protein, 24 aa, Corononavirus-HKU1
LPTLDLTKTAKPLLTSNLSKKARL

SEQ ID NO: 1943 - protein, 19 aa, Corononavirus-HKU1
VQSTCTLATVTYTGKSERV

SEQ ID NO: 1944 - protein, 9 aa, Corononavirus-HKU1
PVPSLTPCI

SEQ ID NO: 1945 - protein, 9 aa, Corononavirus-HKU1
PRITVAVNV

SEQ ID NO: 1946 - protein, 41 aa, Corononavirus-HKU1
SSITGLTNILPFISIHIRLLVSGLKLHQLPVLIKSRILLTK

SEQ ID NO: 1947 - protein, 23 aa, Corononavirus-HKU1
RIHITIEIIVNTIENARKALFKA

SEQ ID NO: 1948 - protein, 23 aa, Corononavirus-HKU1
KQLNIVKVIVNGHISQRIIILIR

SEQ ID NO: 1949 - protein, 7 aa, Corononavirus-HKU1
TNILRLV

SEQ ID NO: 1950 - protein, 26 aa, Corononavirus-HKU1
PNCNMIVIKSSITPKEKFHSFKNVTA

SEQ ID NO: 1951 - protein, 4 aa, Corononavirus-HKU1
SEVN

SEQ ID NO: 1952 - protein, 20 aa, Corononavirus-HKU1
GRKDLFIMFRFRLNNLKWVV

SEQ ID NO: 1953 - protein, 21 aa, Corononavirus-HKU1
LVHYKTYTTAYLFYKRKPKVK

SEQ ID NO: 1954 - protein, 12 aa, Corononavirus-HKU1
RNYKNHKVAYKA

SEQ ID NO: 1955 - protein, 11 aa, Corononavirus-HKU1
LLKKQQQRLKK

SEQ ID NO: 1956 - protein, 17 aa, Corononavirus-HKU1
DKIKLKLKSVLCTKQYH

SEQ ID NO: 1957 - protein, 34 aa, Corononavirus-HKU1
KINQPYLLSASARQTINSEADSTNLDTASETVLP

SEQ ID NO: 1958 - protein, 16 aa, Corononavirus-HKU1
VVKLVTTPKLLLWEIS

SEQ ID NO: 1959 - protein, 5 aa, Corononavirus-HKU1
LRNVK

SEQ ID NO: 1960 - protein, 17 aa, Corononavirus-HKU1
EANLPNLRHQTFKGTIQ

SEQ ID NO: 1961 - protein, 4 aa, Corononavirus-HKU1
PTIG

SEQ ID NO: 1962 - protein, 22 aa, Corononavirus-HKU1
LYFRHKSSRFVTPNSLITRECV

SEQ ID NO: 1963 - protein, 10 aa, Corononavirus-HKU1
LGLQTSINKV

SEQ ID NO: 1964 - protein, 12 aa, Corononavirus-HKU1
DLTRDSNHHEMF

SEQ ID NO: 1965 - protein, 16 aa, Corononavirus-HKU1
QNHDDHHTHHNNYDIY

SEQ ID NO: 1966 - protein, 11 aa, Corononavirus-HKU1
NMQNHNQYNNI

SEQ ID NO: 1967 - protein, 8 aa, Corononavirus-HKU1
KRAIQGIL

SEQ ID NO: 1968 - protein, 23 aa, Corononavirus-HKU1
MKKKLVAKHTKAILHTFHMYLYL

SEQ ID NO: 1969 - protein, 7 aa, Corononavirus-HKU1
YNYYSKT

SEQ ID NO: 1970 - protein, 10 aa, Corononavirus-HKU1
DSSHNTNLKK

SEQ ID NO: 1971 - protein, 7 aa, Corononavirus-HKU1
YEDLKSN

SEQ ID NO: 1972 - protein, 7 aa, Corononavirus-HKU1
AQWMFDF

SEQ ID NO: 1973 - protein, 24 aa, Corononavirus-HKU1
TNEITQIQNQTILVQNDSNKQEAL

SEQ ID NO: 1974 - protein, 5 aa, Corononavirus-HKU1
QNKYS

SEQ ID NO: 1975 - protein, 17 aa, Corononavirus-HKU1
KQHFYLKLVQDNSKNYQ

SEQ ID NO: 1976 - protein, 7 aa, Corononavirus-HKU1
TSNDHYV

SEQ ID NO: 1977 - protein, 4 aa, Corononavirus-HKU1
NTLV

SEQ ID NO: 1978 - protein, 18 aa, Corononavirus-HKU1
VQYLHHLIYTNQDLLKQF

SEQ ID NO: 1979 - protein, 21 aa, Corononavirus-HKU1
TTNHKEHFELMTKYDYHYHKN

SEQ ID NO: 1980 - protein, 6 aa, Corononavirus-HKU1
YEEIDF

SEQ ID NO: 1981 - protein, 12 aa, Corononavirus-HKU1
LKQHQILQEKYH

SEQ ID NO: 1982 - protein, 14 aa, Corononavirus-HKU1
AVERHKHLKQLNDH

SEQ ID NO: 1983 - protein, 22 aa, Corononavirus-HKU1
AYQSEPEPLKHRDEIKFLVKKN

SEQ ID NO: 1984 - protein, 5 aa, Corononavirus-HKU1
LHQIY

SEQ ID NO: 1985 - protein, 7 aa, Corononavirus-HKU1
IIAVTNY

SEQ ID NO: 1986 - protein, 4 aa, Corononavirus-HKU1
VLEH

SEQ ID NO: 1987 - protein, 5 aa, Corononavirus-HKU1
QHFVF

SEQ ID NO: 1988 - protein, 5 aa, Corononavirus-HKU1
QVQSW

SEQ ID NO: 1989 - protein, 4 aa, Corononavirus-HKU1
NHSE

SEQ ID NO: 1990 - protein, 5 aa, Corononavirus-HKU1
KEEHY

SEQ ID NO: 1991 - protein, 7 aa, Corononavirus-HKU1
LSTFDFY

SEQ ID NO: 1992 - protein, 4 aa, Corononavirus-HKU1
HPNH

SEQ ID NO: 1993 - protein, 5 aa, Corononavirus-HKU1
FYIVH

SEQ ID NO: 1994 - protein, 14 aa, Corononavirus-HKU1
EKMVCQLLLTMVET

SEQ ID NO: 1995 - protein, 13 aa, Corononavirus-HKU1
RLWCNQKFEIQTK

SEQ ID NO: 1996 - protein, 4 aa, Corononavirus-HKU1
EAKL

SEQ ID NO: 1997 - protein, 8 aa, Corononavirus-HKU1
RIVHKEDL

SEQ ID NO: 1998 - protein, 19 aa, Corononavirus-HKU1
FHYHQYNCYKLQQNQHLKV

SEQ ID NO: 1999 - protein, 26 aa, Corononavirus-HKU1
LCQTINLQKKNEKKNRSVDLNIQLGI

SEQ ID NO: 2000 - protein, 8 aa, Corononavirus-HKU1
YYQHQNAN

SEQ ID NO: 2001 - protein, 8 aa, Corononavirus-HKU1
EYQLHAIE

SEQ ID NO: 2002 - protein, 5 aa, Corononavirus-HKU1
YQVNH

SEQ ID NO: 2003 - protein, 6 aa, Corononavirus-HKU1
LHLKYY

SEQ ID NO: 2004 - protein, 18 aa, Corononavirus-HKU1
YYHKKCHTLTISHGKLHN

SEQ ID NO: 2005 - protein, 8 aa, Corononavirus-HKU1
NRQIKNNQ

SEQ ID NO: 2006 - protein, 6 aa, Corononavirus-HKU1
IPLDQL

SEQ ID NO: 2007 - protein, 12 aa, Corononavirus-HKU1
SHKDHPQTQYCH

SEQ ID NO: 2008 - protein, 4 aa, Corononavirus-HKU1
RVQK

SEQ ID NO: 2009 - protein, 46 aa, Corononavirus-HKU1
QNDKKQKYFYVYDAKRKKKVSYNQHKNHYPCEEHKKKQNNQLNYQH

SEQ ID NO: 2010 - protein, 12 aa, Corononavirus-HKU1
KRNQDNYQNMAE

SEQ ID NO: 2011 - protein, 43 aa, Corononavirus-HKU1
LKKYYSKHSYILNYDKVKPKRKHFDEKQQKLFLHNKGKYYMFY

SEQ ID NO: 2012 - protein, 17 aa, Corononavirus-HKU1
NHTKDFANYYNKQQKLL

SEQ ID NO: 2013 - protein, 5 aa, Corononavirus-HKU1
KYLVL

SEQ ID NO: 2014 - protein, 11 aa, Corononavirus-HKU1
YHKGRNQHKHQ

SEQ ID NO: 2015 - protein, 4 aa, Corononavirus-HKU1
KLQY

SEQ ID NO: 2016 - protein, 5 aa, Corononavirus-HKU1
AAINH

SEQ ID NO: 2017 - protein, 6 aa, Corononavirus-HKU1
NKWYHY

SEQ ID NO: 2018 - protein, 4 aa, Corononavirus-HKU1
YHLK

SEQ ID NO: 2019 - protein, 8 aa, Corononavirus-HKU1
KKYYNGCY

SEQ ID NO: 2020 - protein, 52 aa, Corononavirus-HKU1
RKCHKTNLERHQYYKDKKHYMIHPIHHTFLHQHRTLHNVHQHQPETFFENKT

SEQ ID NO: 2021 - protein, 5 aa, Corononavirus-HKU1
GHKQL

SEQ ID NO: 2022 - protein, 16 aa, Corononavirus-HKU1
DQVNKNTYTSQCGRVQ

SEQ ID NO: 2023 - protein, 7 aa, Corononavirus-HKU1
YSHKNDN

SEQ ID NO: 2024 - protein, 18 aa, Corononavirus-HKU1
DRKQKVVYDSCNLKQKKV

SEQ ID NO: 2025 - protein, 7 aa, Corononavirus-HKU1
HKDKKYY

SEQ ID NO: 2026 - protein, 15 aa, Corononavirus-HKU1
QKNNNVSKQHYESSN

SEQ ID NO: 2027 - protein, 13 aa, Corononavirus-HKU1
NHTFYSKKKDYNY

SEQ ID NO: 2028 - protein, 11 aa, Corononavirus-HKU1
LQANYNTIDKN

SEQ ID NO: 2029 - protein, 5 aa, Corononavirus-HKU1
CQFYN

SEQ ID NO: 2030 - protein, 28 aa, Corononavirus-HKU1
KIAENQNCPTANQIVWSWVWQIYLKQYS

SEQ ID NO: 2031 - protein, 6 aa, Corononavirus-HKU1
NNYHIS

SEQ ID NO: 2032 - protein, 21 aa, Corononavirus-HKU1
IHQNYYKKKNQYELNEAKYSN

SEQ ID NO: 2033 - protein, 7 aa, Corononavirus-HKU1
KKFYVPN

SEQ ID NO: 2034 - protein, 5 aa, Corononavirus-HKU1
EVRVH

SEQ ID NO: 2035 - protein, 21 aa, Corononavirus-HKU1
AIYQCHNQVNQEYDDVQLQQA

SEQ ID NO: 2036 - protein, 9 aa, Corononavirus-HKU1
NQISHKHQY

SEQ ID NO: 2037 - protein, 4 aa, Corononavirus-HKU1
VIKI

SEQ ID NO: 2038 - protein, 6 aa, Corononavirus-HKU1
FYIESR

SEQ ID NO: 2039 - protein, 5 aa, Corononavirus-HKU1
NNQQH

SEQ ID NO: 2040 - protein, 6 aa, Corononavirus-HKU1
HHGCQI

SEQ ID NO: 2041 - protein, 5 aa, Corononavirus-HKU1
EDIGV

SEQ ID NO: 2042 - protein, 10 aa, Corononavirus-HKU1
PNIVKSHYQY

SEQ ID NO: 2043 - protein, 19 aa, Corononavirus-HKU1
HYKSKAKHNNEIKEYQDTN

SEQ ID NO: 2044 - protein, 24 aa, Corononavirus-HKU1
ACQNQHNKHKKCHVLDKNENTTNL

SEQ ID NO: 2045 - protein, 4 aa, Corononavirus-HKU1
KHYK

SEQ ID NO: 2046 - protein, 19 aa, Corononavirus-HKU1
TDTKVQIYQNAKIHYENYL

SEQ ID NO: 2047 - protein, 6 aa, Corononavirus-HKU1
YEDTHT

SEQ ID NO: 2048 - protein, 5 aa, Corononavirus-HKU1
CIDKL

SEQ ID NO: 2049 - protein, 11 aa, Corononavirus-HKU1
SPKHHYEVEQQ

SEQ ID NO: 2050 - protein, 4 aa, Corononavirus-HKU1
YKSC

SEQ ID NO: 2051 - protein, 4 aa, Corononavirus-HKU1
KHYL

SEQ ID NO: 2052 - protein, 7 aa, Corononavirus-HKU1
THYTKFY

SEQ ID NO: 2053 - protein, 5 aa, Corononavirus-HKU1
KKYHY

SEQ ID NO: 2054 - protein, 15 aa, Corononavirus-HKU1
NQIKRVSDTKEYSNM

SEQ ID NO: 2055 - protein, 7 aa, Corononavirus-HKU1
YLLKIDP

SEQ ID NO: 2056 - protein, 5 aa, Corononavirus-HKU1
NWHQI

SEQ ID NO: 2057 - protein, 4 aa, Corononavirus-HKU1
GNNQ

SEQ ID NO: 2058 - protein, 33 aa, Corononavirus-HKU1
YLNKHDQVYNMYPNHKKHPQHTHLCEELWCLNH

SEQ ID NO: 2059 - protein, 4 aa, Corononavirus-HKU1
QLML

SEQ ID NO: 2060 - protein, 13 aa, Corononavirus-HKU1
LITCLDLMRFIVI

SEQ ID NO: 2061 - protein, 5 aa, Corononavirus-HKU1
KNNKK

SEQ ID NO: 2062 - protein, 35 aa, Corononavirus-HKU1
NNRQKIINTNWMFNNRRCRTPTKRIIGPNGCKIII

SEQ ID NO: 2063 - protein, 5 aa, Corononavirus-HKU1
KYTII

SEQ ID NO: 2064 - protein, 6 aa, Corononavirus-HKU1
NTRNII

SEQ ID NO: 2065 - protein, 34 aa, Corononavirus-HKU1
NRNKTTITVVNIILANIISRRIAKITIWQLTCNR

SEQ ID NO: 2066 - protein, 28 aa, Corononavirus-HKU1
GTLVVPSRINNLYRYKLFRFIKTESFSR

SEQ ID NO: 2067 - protein, 20 aa, Corononavirus-HKU1
KRCSGGNFIRTWFKRNINTV

SEQ ID NO: 2068 - protein, 32 aa, Corononavirus-HKU1
IRINNIRKTINRASIYVIIVLTKVRFKKAKRY

SEQ ID NO: 2069 - protein, 5 aa, Corononavirus-HKU1
IKRTT

SEQ ID NO: 2070 - protein, 16 aa, Corononavirus-HKU1
SKINFLRIINKNRIVK

SEQ ID NO: 2071 - protein, 31 aa, Corononavirus-HKU1
NITFTRIKLRKRNIIRNINKSKITKKGHIRI

SEQ ID NO: 2072 - protein, 61 aa, Corononavirus-HKU1
GTIKSYLVKKPYIITTIRKTLKSMIRIKINTLIKNNLITFASVIIKSSEMKTLKNRITGTR

SEQ ID NO: 2073 - protein, 20 aa, Corononavirus-HKU1
NLTIVAQTRVNIQIIKIFNF

SEQ ID NO: 2074 - protein, 13 aa, Corononavirus-HKU1
IINMVTIRTTITK

SEQ ID NO: 2075 - protein, 5 aa, Corononavirus-HKU1
KPVMV

SEQ ID NO: 2076 - protein, 17 aa, Corononavirus-HKU1
MRHNIKRFIKTITEIKK

SEQ ID NO: 2077 - protein, 33 aa, Corononavirus-HKU1
HSLDLMRSNKYLQDYHQQKSLYAYRELIIYLFQ

SEQ ID NO: 2078 - protein, 13 aa, Corononavirus-HKU1
ENKLNHLIDLVLN

SEQ ID NO: 2079 - protein, 11 aa, Corononavirus-HKU1
QQQCQPISKKI

SEQ ID NO: 2080 - protein, 21 aa, Corononavirus-HKU1
SYQINYKHRHSMLYYFSKTNS

SEQ ID NO: 2081 - protein, 21 aa, Corononavirus-HKU1
HCHLFQKKIYPGNLYLLKTLH

SEQ ID NO: 2082 - protein, 5 aa, Corononavirus-HKU1
KKHLH

SEQ ID NO: 2083 - protein, 23 aa, Corononavirus-HKU1
YKKLSKMQNNSLIYINQHSKKTL

SEQ ID NO: 2084 - protein, 17 aa, Corononavirus-HKU1
LHYHPKIIYHELNDKCK

SEQ ID NO: 2085 - protein, 13 aa, Corononavirus-HKU1
KTHPYSHYNHQYF

SEQ ID NO: 2086 - protein, 25 aa, Corononavirus-HKU1
EDHTYQILSNPNDNQMVKSYNLQNK

SEQ ID NO: 2087 - protein, 4 aa, Corononavirus-HKU1
LNYR

SEQ ID NO: 2088 - protein, 40 aa, Corononavirus-HKU1
QMGLNHYLQEYYQMVTTVLKQQNLELLLYQTLHLNVKHAY

SEQ ID NO: 2089 - protein, 6 aa, Corononavirus-HKU1
QEQLML

SEQ ID NO: 2090 - protein, 10 aa, Corononavirus-HKU1
YSNTDIIECT

SEQ ID NO: 2091 - protein, 7 aa, Corononavirus-HKU1
QHSSYSL

SEQ ID NO: 2092 - protein, 22 aa, Corononavirus-HKU1
VYHNSIKRLSLMEHSNTYTKQA

SEQ ID NO: 2093 - protein, 7 aa, Corononavirus-HKU1
NSQVSNH

SEQ ID NO: 2094 - protein, 4 aa, Corononavirus-HKU1
WLAF

SEQ ID NO: 2095 - protein, 4 aa, Corononavirus-HKU1
DKKS

SEQ ID NO: 2096 - protein, 8 aa, Corononavirus-HKU1
FYYHYTTT

SEQ ID NO: 2097 - protein, 4 aa, Corononavirus-HKU1
IENP

SEQ ID NO: 2098 - protein, 7 aa, Corononavirus-HKU1
HNSNLMT

SEQ ID NO: 2099 - protein, 9 aa, Corononavirus-HKU1
KQNHLIINQ

SEQ ID NO: 2100 - protein, 13 aa, Corononavirus-HKU1
LYKHSYYYHTPDQ

SEQ ID NO: 2101 - protein, 5 aa, Corononavirus-HKU1
NMNEY

SEQ ID NO: 2102 - protein, 11 aa, Corononavirus-HKU1
NHTVKTLELTN

SEQ ID NO: 2103 - protein, 9 aa, Corononavirus-HKU1
IFFSYEISL

SEQ ID NO: 2104 - protein, 6 aa, Corononavirus-HKU1
ANANLL

SEQ ID NO: 2105 - protein, 16 aa, Corononavirus-HKU1
NYHKLYDQMHSLLNHI

SEQ ID NO: 2106 - protein, 7 aa, Corononavirus-HKU1
TDYHPYQ

SEQ ID NO: 2107 - protein, 18 aa, Corononavirus-HKU1
NPVLNLSEVQNLTIHDSE

SEQ ID NO: 2108 - protein, 8 aa, Corononavirus-HKU1
NVLEHHYQ

SEQ ID NO: 2109 - protein, 25 aa, Corononavirus-HKU1
HYPRNYHLDYLVGSSNGLSIGCLFG

SEQ ID NO: 2110 - protein, 7 aa, Corononavirus-HKU1
HRHHLFS

SEQ ID NO: 2111 - protein, 6 aa, Corononavirus-HKU1
RTKTQL

SEQ ID NO: 2112 - protein, 18 aa, Corononavirus-HKU1
VLQLYPQSHHLNQLVADL

SEQ ID NO: 2113 - protein, 10 aa, Corononavirus-HKU1
SLITYLIFQY

SEQ ID NO: 2114 - protein, 7 aa, Corononavirus-HKU1
KHHFLLF

SEQ ID NO: 2115 - protein, 18 aa, Corononavirus-HKU1
KLLKRQCHDHQKVYSNFR

SEQ ID NO: 2116 - protein, 19 aa, Corononavirus-HKU1
TSNLCIYKHHKWNYKTNYL

SEQ ID NO: 2117 - protein, 16 aa, Corononavirus-HKU1
HNPTGHASNKYQCSNF

SEQ ID NO: 2118 - protein, 10 aa, Corononavirus-HKU1
VQGGAGYYVL

SEQ ID NO: 2119 - protein, 6 aa, Corononavirus-HKU1
TIQQLY

SEQ ID NO: 2120 - protein, 6 aa, Corononavirus-HKU1
EMMYYF

SEQ ID NO: 2121 - protein, 5 aa, Corononavirus-HKU1
QYLHY

SEQ ID NO: 2122 - protein, 6 aa, Corononavirus-HKU1
QQLCHS

SEQ ID NO: 2123 - protein, 14 aa, Corononavirus-HKU1
HKVIHLYVHHNDQH

SEQ ID NO: 2124 - protein, 12 aa, Corononavirus-HKU1
PSYILRFLNSVT

SEQ ID NO: 2125 - protein, 16 aa, Corononavirus-HKU1
KCSINYKNQNSYKPKK

SEQ ID NO: 2126 - protein, 26 aa, Corononavirus-HKU1
LYYKTQGSYNILQHALNKQLHLDYTV

SEQ ID NO: 2127 - protein, 13 aa, Corononavirus-HKU1
YKWRFLKERNQLV

SEQ ID NO: 2128 - protein, 18 aa, Corononavirus-HKU1
ILNHLRTHKAYLNNRKKA

SEQ ID NO: 2129 - protein, 6 aa, Corononavirus-HKU1
DFQKQF

SEQ ID NO: 2130 - protein, 6 aa, Corononavirus-HKU1
YGMHVY

SEQ ID NO: 2131 - protein, 26 aa, Corononavirus-HKU1
HTNYHHYIQEGLIYLTLECQIYKQLN

SEQ ID NO: 2132 - protein, 16 aa, Corononavirus-HKU1
MDIYQHYNSKTYINHL

SEQ ID NO: 2133 - protein, 13 aa, Corononavirus-HKU1
NYLYAHHRHKITV

SEQ ID NO: 2134 - protein, 11 aa, Corononavirus-HKU1
QTWLQEKHHKI

SEQ ID NO: 2135 - protein, 4 aa, Corononavirus-HKU1
IHNL

SEQ ID NO: 2136 - protein, 5 aa, Corononavirus-HKU1
HKLNL

SEQ ID NO: 2137 - protein, 17 aa, Corononavirus-HKU1
DCLCHNISCIYYIAWQL

SEQ ID NO: 2138 - protein, 11 aa, Corononavirus-HKU1
HAAITYKMYLY

SEQ ID NO: 2139 - protein, 9 aa, Corononavirus-HKU1
KLLDTLNSN

SEQ ID NO: 2140 - protein, 14 aa, Corononavirus-HKU1
QIYKNNHRLLNNES

SEQ ID NO: 2141 - protein, 20 aa, Corononavirus-HKU1
LHQLTQHVHLYVHYKLYRDY

SEQ ID NO: 2142 - protein, 13 aa, Corononavirus-HKU1
LKNLYNPTVVYLQ

SEQ ID NO: 2143 - protein, 20 aa, Corononavirus-HKU1
VDYTHNHKYNYGANNHNNQF

SEQ ID NO: 2144 - protein, 4 aa, Corononavirus-HKU1
NCSM

SEQ ID NO: 2145 - protein, 5 aa, Corononavirus-HKU1
NTHYN

SEQ ID NO: 2146 - protein, 5 aa, Corononavirus-HKU1
ALCLI

SEQ ID NO: 2147 - protein, 6 aa, Corononavirus-HKU1
QNTLNK

SEQ ID NO: 2148 - protein, 7 aa, Corononavirus-HKU1
VQNWQTK

SEQ ID NO: 2149 - protein, 18 aa, Corononavirus-HKU1
ILHYQKGLKDNQITFEQF

SEQ ID NO: 2150 - protein, 9 aa, Corononavirus-HKU1
QYPTFDLLT

SEQ ID NO: 2151 - protein, 5 aa, Corononavirus-HKU1
GVLNV

SEQ ID NO: 2152 - protein, 7 aa, Corononavirus-HKU1
IFHQEEL

SEQ ID NO: 2153 - protein, 4 aa, Corononavirus-HKU1
LQFF

SEQ ID NO: 2154 - protein, 11 aa, Corononavirus-HKU1
KYNNLSQQISQ

SEQ ID NO: 2155 - protein, 24 aa, Corononavirus-HKU1
LQLQNPHQLKNLFAVESLFQCFRE

SEQ ID NO: 2156 - protein, 12 aa, Corononavirus-HKU1
HERPQHQNQPNL

SEQ ID NO: 2157 - protein, 4 aa, Corononavirus-HKU1
WLHL

SEQ ID NO: 2158 - protein, 9 aa, Corononavirus-HKU1
NNHQESNLI

SEQ ID NO: 2159 - protein, 22 aa, Corononavirus-HKU1
EILNENMLKQVHKYLNLQPNFH

SEQ ID NO: 2160 - protein, 26 aa, Corononavirus-HKU1
PYIYHQLLKMRGHALDDNLSNFYYNL

SEQ ID NO: 2161 - protein, 18 aa, Corononavirus-HKU1
LCNANEVKFDFEFYLKVE

SEQ ID NO: 2162 - protein, 9 aa, Corononavirus-HKU1
EIQIIAYYS

SEQ ID NO: 2163 - protein, 8 aa, Corononavirus-HKU1
HKKCPSWL

SEQ ID NO: 2164 - protein, 4 aa, Corononavirus-HKU1
LWQH

SEQ ID NO: 2165 - protein, 11 aa, Corononavirus-HKU1
QNGLFLLFVNI

SEQ ID NO: 2166 - protein, 21 aa, Corononavirus-HKU1
HNHIPNLEQNLQFVFEHLKHA

SEQ ID NO: 2167 - protein, 9 aa, Corononavirus-HKU1
QHNSDYYKD

SEQ ID NO: 2168 - protein, 8 aa, Corononavirus-HKU1
KQHYSKLD

SEQ ID NO: 2169 - protein, 5 aa, Corononavirus-HKU1
LLKIY

SEQ ID NO: 2170 - protein, 19 aa, Corononavirus-HKU1
LDISVEYLQHLNSHVLSVP

SEQ ID NO: 2171 - protein, 8 aa, Corononavirus-HKU1
NIMNYYHF

SEQ ID NO: 2172 - protein, 15 aa, Corononavirus-HKU1
VYYHKPMLKQFLQFL

SEQ ID NO: 2173 - protein, 18 aa, Corononavirus-HKU1
DTYNNFPKRYQDLNNTLF

SEQ ID NO: 2174 - protein, 25 aa, Corononavirus-HKU1
VLKNPCSTAHVVQVIEQDLQYIHNV

SEQ ID NO: 2175 - protein, 4 aa, Corononavirus-HKU1
YEHL

SEQ ID NO: 2176 - protein, 5 aa, Corononavirus-HKU1
QTIHN

SEQ ID NO: 2177 - protein, 8 aa, Corononavirus-HKU1
LHQQQQYL

SEQ ID NO: 2178 - protein, 9 aa, Corononavirus-HKU1
PTLVMHLLW

SEQ ID NO: 2179 - protein, 8 aa, Corononavirus-HKU1
KHTYKWYH

SEQ ID NO: 2180 - protein, 9 aa, Corononavirus-HKU1
TYHNNLHEL

SEQ ID NO: 2181 - protein, 5 aa, Corononavirus-HKU1
YVYNR

SEQ ID NO: 2182 - protein, 17 aa, Corononavirus-HKU1
YLKTYKLFHTMHLQQHD

SEQ ID NO: 2183 - protein, 16 aa, Corononavirus-HKU1
QQYKLHVLCSNKQLDL

SEQ ID NO: 2184 - protein, 24 aa, Corononavirus-HKU1
QDETFPYQGDLEQCNNVSFQCADN

SEQ ID NO: 2185 - protein, 13 aa, Corononavirus-HKU1
QHYFETPMEHYKH

SEQ ID NO: 2186 - protein, 4 aa, Corononavirus-HKU1
KILY

SEQ ID NO: 2187 - protein, 8 aa, Corononavirus-HKU1
HSSLVGQV

SEQ ID NO: 2188 - protein, 4 aa, Corononavirus-HKU1
VHLN

SEQ ID NO: 2189 - protein, 12 aa, Corononavirus-HKU1
LQNVMLKQKHHL

SEQ ID NO: 2190 - protein, 4 aa, Corononavirus-HKU1
KVYK

SEQ ID NO: 2191 - protein, 6 aa, Corononavirus-HKU1
RGNTHR

SEQ ID NO: 2192 - protein, 17 aa, Corononavirus-HKU1
LIHFYQKHTHLKLSYQY

SEQ ID NO: 2193 - protein, 4 aa, Corononavirus-HKU1
NGSL

SEQ ID NO: 2194 - protein, 5 aa, Corononavirus-HKU1
KHNFY

SEQ ID NO: 2195 - protein, 8 aa, Corononavirus-HKU1
LYLSPNTK

SEQ ID NO: 2196 - protein, 4 aa, Corononavirus-HKU1
LLYH

SEQ ID NO: 2197 - protein, 5 aa, Corononavirus-HKU1
QSLEW

SEQ ID NO: 2198 - protein, 6 aa, Corononavirus-HKU1
QKHSFV

SEQ ID NO: 2199 - protein, 34 aa, Corononavirus-HKU1
KPLQLPFEFLQQITLNVQYTHLPEHNHQLLSIYN

SEQ ID NO: 2200 - protein, 21 aa, Corononavirus-HKU1
NHLYKVNPCKIVYTNQRPYHS

SEQ ID NO: 2201 - protein, 20 aa, Corononavirus-HKU1
MNNGVYGFHNSKTYRPNIIW

SEQ ID NO: 2202 - protein, 6 aa, Corononavirus-HKU1
HHSHHS

SEQ ID NO: 2203 - protein, 15 aa, Corononavirus-HKU1
VHYKRKVRHSKHIYD

SEQ ID NO: 2204 - protein, 50 aa, Corononavirus-HKU1
HGHNNIYNITKAYVYNCHNAKKFVMNKQRMHLHSASRHFLNTYSCKMILQ

SEQ ID NO: 2205 - protein, 9 aa, Corononavirus-HKU1
TLNHHKYLK

SEQ ID NO: 2206 - protein, 41 aa, Corononavirus-HKU1
HYNYLRSEYQDHYTVFLYILNIHERLFGILHFHDVLKGKHL

SEQ ID NO: 2207 - protein, 27 aa, Corononavirus-HKU1
LDLQSALSKEHCQSSINHQQNNQLLKF

SEQ ID NO: 2208 - protein, 14 aa, Corononavirus-HKU1
KDLDMVNKHNHHLS

SEQ ID NO: 2209 - protein, 10 aa, Corononavirus-HKU1
YVGNKIHEDH

SEQ ID NO: 2210 - protein, 7 aa, Corononavirus-HKU1
YHFQPNI

SEQ ID NO: 2211 - protein, 15 aa, Corononavirus-HKU1
RHYSDSTKLVEKHLY

SEQ ID NO: 2212 - protein, 5 aa, Corononavirus-HKU1
LYNPY

SEQ ID NO: 2213 - protein, 17 aa, Corononavirus-HKU1
HNQSYNRQHHHHSKSSY

SEQ ID NO: 2214 - protein, 10 aa, Corononavirus-HKU1
NAYIKIHNTH

SEQ ID NO: 2215 - protein, 12 aa, Corononavirus-HKU1
QMYNQHNLYDKH

SEQ ID NO: 2216 - protein, 21 aa, Corononavirus-HKU1
SISVFVNCVYLNLQSYGHYRP

SEQ ID NO: 2217 - protein, 4 aa, Corononavirus-HKU1
ENKH

SEQ ID NO: 2218 - protein, 5 aa, Corononavirus-HKU1
QPDIY

SEQ ID NO: 2219 - protein, 5 aa, Corononavirus-HKU1
LHHHC

SEQ ID NO: 2220 - protein, 4 aa, Corononavirus-HKU1
YHQA

SEQ ID NO: 2221 - protein, 7 aa, Corononavirus-HKU1
HNSNRHT

SEQ ID NO: 2222 - protein, 33 aa, Corononavirus-HKU1
LFHSKLEHIHSQGDKIYHHVNNKIHVCGPKLNY

SEQ ID NO: 2223 - protein, 7 aa, Corononavirus-HKU1
QYAKYLA

SEQ ID NO: 2224 - protein, 4 aa, Corononavirus-HKU1
HDHI

SEQ ID NO: 2225 - protein, 5 aa, Corononavirus-HKU1
DNPNP

SEQ ID NO: 2226 - protein, 8 aa, Corononavirus-HKU1
EQGCQHPL

SEQ ID NO: 2227 - protein, 12 aa, Corononavirus-HKU1
DDVTYRPNHHKI

SEQ ID NO: 2228 - protein, 6 aa, Corononavirus-HKU1
QQEHLG

SEQ ID NO: 2229 - protein, 15 aa, Corononavirus-HKU1
LLYSSNIFDGTFGLS

SEQ ID NO: 2230 - protein, 10 aa, Corononavirus-HKU1
KHLLQCELYS

SEQ ID NO: 2231 - protein, 15 aa, Corononavirus-HKU1
HILNSFELRWAEHYV

SEQ ID NO: 2232 - protein, 24 aa, Corononavirus-HKU1
YMHKFHSVPQMIMPHNKVWLYQIY

SEQ ID NO: 2233 - protein, 10 aa, Corononavirus-HKU1
MDNQHFYHNY

SEQ ID NO: 2234 - protein, 26 aa, Corononavirus-HKU1
LVMLVYNHHHKFQNIYKQLLIQTITA

SEQ ID NO: 2235 - protein, 10 aa, Corononavirus-HKU1
VNYTYNNYNQ

SEQ ID NO: 2236 - protein, 7 aa, Corononavirus-HKU1
LQHYHLE

SEQ ID NO: 2237 - protein, 12 aa, Corononavirus-HKU1
RKNVSNQLYYPL

SEQ ID NO: 2238 - protein, 5 aa, Corononavirus-HKU1
TSLYF

SEQ ID NO: 2239 - protein, 7 aa, Corononavirus-HKU1
QTRKSLG

SEQ ID NO: 2240 - protein, 13 aa, Corononavirus-HKU1
SYLVLQFEILYHL

SEQ ID NO: 2241 - protein, 4 aa, Corononavirus-HKU1
WQLH

SEQ ID NO: 2242 - protein, 10 aa, Corononavirus-HKU1
NNKFVNQAEH

SEQ ID NO: 2243 - protein, 5 aa, Corononavirus-HKU1
QMQRA

SEQ ID NO: 2244 - protein, 10 aa, Corononavirus-HKU1
QDLLHKEVNL

SEQ ID NO: 2245 - protein, 13 aa, Corononavirus-HKU1
ETNDNGVCQHLSS

SEQ ID NO: 2246 - protein, 10 aa, Corononavirus-HKU1
LHLTLCNGNQ

SEQ ID NO: 2247 - protein, 12 aa, Corononavirus-HKU1
KQQTVHHLQKFV

SEQ ID NO: 2248 - protein, 7 aa, Corononavirus-HKU1
QGDQNKY

SEQ ID NO: 2249 - protein, 4 aa, Corononavirus-HKU1
VKPY

SEQ ID NO: 2250 - protein, 10 aa, Corononavirus-HKU1
YTYHYHNPQY

SEQ ID NO: 2251 - protein, 8 aa, Corononavirus-HKU1
DDTSYPNT

SEQ ID NO: 2252 - protein, 7 aa, Corononavirus-HKU1
TTLTCNQ

SEQ ID NO: 2253 - protein, 13 aa, Corononavirus-HKU1
NHTVQDRIVYNYH

SEQ ID NO: 2254 - protein, 10 aa, Corononavirus-HKU1
QIIHNLIHDT

SEQ ID NO: 2255 - protein, 20 aa, Corononavirus-HKU1
ASYKNSKNLQLPHQTLGLFV

SEQ ID NO: 2256 - protein, 31 aa, Corononavirus-HKU1
NHQNHTIDHTNLGYLKLKHQLNLLQLRCLQK

SEQ ID NO: 2257 - protein, 4 aa, Corononavirus-HKU1
VKLY

SEQ ID NO: 2258 - protein, 7 aa, Corononavirus-HKU1
GLIFYIY

SEQ ID NO: 2259 - protein, 12 aa, Corononavirus-HKU1
YQDFQQNHTNLS

SEQ ID NO: 2260 - protein, 34 aa, Corononavirus-HKU1
KSRILYNQHTHKEFHTILNNHYDQNDAMHSKDLT

SEQ ID NO: 2261 - protein, 20 aa, Corononavirus-HKU1
YTLKDSYELYVARDYHQYQM

SEQ ID NO: 2262 - protein, 11 aa, Corononavirus-HKU1
RNHVQPQHHNF

SEQ ID NO: 2263 - protein, 14 aa, Corononavirus-HKU1
STHNKFSLYYKLLN

SEQ ID NO: 2264 - protein, 44 aa, Corononavirus-HKU1
QQRTYPIYYRRHLYAENGNNSLYNINLYQLYWYYKCQMPLIEHQ

SEQ ID NO: 2265 - protein, 9 aa, Corononavirus-HKU1
HRVLAGHSH

SEQ ID NO: 2266 - protein, 5 aa, Corononavirus-HKU1
YPEPV

SEQ ID NO: 2267 - protein, 8 aa, Corononavirus-HKU1
IFRLNSDT

SEQ ID NO: 2268 - protein, 20 aa, Corononavirus-HKU1
TYTGTTAISPKTTDLTNIMC

SEQ ID NO: 2269 - protein, 18 aa, Corononavirus-HKU1
HIKNRIFYTQRDLYKFTT

SEQ ID NO: 2270 - protein, 19 aa, Corononavirus-HKU1
FTYTIYIWMLYTCTAINTN

SEQ ID NO: 2271 - protein, 43 aa, Corononavirus-HKU1
GTTIRILVNSSLRFNSNGHTSTSMITEHFNTINYRYTTLLYII

SEQ ID NO: 2272 - protein, 11 aa, Corononavirus-HKU1
ISFLRIYRKCT

SEQ ID NO: 2273 - protein, 19 aa, Corononavirus-HKU1
KYRRISCILSSNTSLQSNC

SEQ ID NO: 2274 - protein, 8 aa, Corononavirus-HKU1
STNNPPSS

SEQ ID NO: 2275 - protein, 29 aa, Corononavirus-HKU1
SVTSFNKIKILNFKSLNILYRKFTRRIKL

SEQ ID NO: 2276 - protein, 54 aa, Corononavirus-HKU1
NNTISIIFHYLSILKTINITKNSINYSTTTTIIIITLSRNITIHIRTTINNLYF

SEQ ID NO: 2277 - protein, 35 aa, Corononavirus-HKU1
FMRHQLIILHNSISNFIIPVRNDNKRPIRINTNIS

SEQ ID NO: 2278 - protein, 40 aa, Corononavirus-HKU1
LFINTISILNSLYMPYTTSICNINIINNFIKNLFIWYYYS

SEQ ID NO: 2279 - protein, 24 aa, Corononavirus-HKU1
SISSQCWNSTQRYTTFNSIIQNRI

SEQ ID NO: 2280 - protein, 37 aa, Corononavirus-HKU1
SLIIQFTNHAKKHCLQSGNNFTLLIINPSLFIHVSKC

SEQ ID NO: 2281 - protein, 26 aa, Corononavirus-HKU1
VCHTFKFASYSFITFIHRLSYITCFF

SEQ ID NO: 2282 - protein, 68 aa, Corononavirus-HKU1
LFYLLLINRTTIFSISQIFLCDFIFNKTSHIYKLTLQSLQNGTILNIIIANFIYTCKTLSINCSRIGE

SEQ ID NO: 2283 - protein, 11 aa, Corononavirus-HKU1
LSKLIKSYTQI

SEQ ID NO: 2284 - protein, 4 aa, Corononavirus-HKU1
YFIM

SEQ ID NO: 2285 - protein, 17 aa, Corononavirus-HKU1
NTTILPQLRIRSNMQML

SEQ ID NO: 2286 - protein, 12 aa, Corononavirus-HKU1
QNNISTFHISQF

SEQ ID NO: 2287 - protein, 17 aa, Corononavirus-HKU1
LNLGDFNNWHATYSKQF

SEQ ID NO: 2288 - protein, 11 aa, Corononavirus-HKU1
QNSLKTITRWT

SEQ ID NO: 2289 - protein, 27 aa, Corononavirus-HKU1
AISIHITQFLNRNFIIINTHRHSKNTV

SEQ ID NO: 2290 - protein, 9 aa, Corononavirus-HKU1
KREKSPITR

SEQ ID NO: 2291 - protein, 5 aa, Corononavirus-HKU1
NIPYK

SEQ ID NO: 2292 - protein, 30 aa, Corononavirus-HKU1
VTQENQFNIRYICKIKYINRQPISNNFCYS

SEQ ID NO: 2293 - protein, 9 aa, Corononavirus-HKU1
QNSGPCIST

SEQ ID NO: 2294 - protein, 5 aa, Corononavirus-HKU1
KGCNK

SEQ ID NO: 2295 - protein, 5 aa, Corononavirus-HKU1
QNILF

SEQ ID NO: 2296 - protein, 9 aa, Corononavirus-HKU1
IRPKIPHRN

SEQ ID NO: 2297 - protein, 28 aa, Corononavirus-HKU1
SNYSTNQKHQRKNVMINTMHSYKNSKNT

SEQ ID NO: 2298 - protein, 19 aa, Corononavirus-HKU1
NTTIKYFINISKIHSRNKI

SEQ ID NO: 2299 - protein, 15 aa, Corononavirus-HKU1
EPDISKTSKTFLINN

SEQ ID NO: 2300 - protein, 24 aa, Corononavirus-HKU1
IIYIKQGTEYRNYIHSQIKMLMFN

SEQ ID NO: 2301 - protein, 10 aa, Corononavirus-HKU1
HHKTNKTKYT

SEQ ID NO: 2302 - protein, 69 aa, Corononavirus-HKU1
CNTNHMCINIHKYSPFNKCRNYTTKQKCRYQNPINCFFNKSFCFRLQFNTSQLLINVRRCQFIFKSTTS

SEQ ID NO: 2303 - protein, 9 aa, Corononavirus-HKU1
YLTTLKSHI

SEQ ID NO: 2304 - protein, 6 aa, Corononavirus-HKU1
TLNSSQ

SEQ ID NO: 2305 - protein, 8 aa, Corononavirus-HKU1
SFNRNTCH

SEQ ID NO: 2306 - protein, 4 aa, Corononavirus-HKU1
SQSI

SEQ ID NO: 2307 - protein, 82 aa, Corononavirus-HKU1
DKICFYLAKTICHSPNIKIFSRTNIILYKPSTIIKYSCIEPSNNINSLDVVLNWQLYNLSISIWTIKITSKISASVTTSTEL

SEQ ID NO: 2308 - protein, 12 aa, Corononavirus-HKU1
LMHIYKLNTITC

SEQ ID NO: 2309 - protein, 7 aa, Corononavirus-HKU1
YITNRST

SEQ ID NO: 2310 - protein, 28 aa, Corononavirus-HKU1
PTQKRTFNSITTTHSNMKCPLWSAIIRS

SEQ ID NO: 2311 - protein, 21 aa, Corononavirus-HKU1
NSKSFTRFNITKSIFWSVRIL

SEQ ID NO: 2312 - protein, 17 aa, Corononavirus-HKU1
RDCQNKLTALHLVRHNC

SEQ ID NO: 2313 - protein, 11 aa, Corononavirus-HKU1
THPTRHYSKIT

SEQ ID NO: 2314 - protein, 5 aa, Corononavirus-HKU1
SNSTQ

SEQ ID NO: 2315 - protein, 11 aa, Corononavirus-HKU1
GRIIRFVHIRG

SEQ ID NO: 2316 - protein, 12 aa, Corononavirus-HKU1
TYNMTRTINFVI

SEQ ID NO: 2317 - protein, 18 aa, Corononavirus-HKU1
TIQSHTTISNTNNTRFNF

SEQ ID NO: 2318 - protein, 9 aa, Corononavirus-HKU1
RRRYHLYNT

SEQ ID NO: 2319 - protein, 14 aa, Corononavirus-HKU1
LQKRCRNRCCRRLV

SEQ ID NO: 2320 - protein, 15 aa, Corononavirus-HKU1
DIITIIVIKCFHSFS

SEQ ID NO: 2321 - protein, 38 aa, Corononavirus-HKU1
LRTRRFSIGSSIHFTTIVTILIIQTQISIVGNIRNRIL

SEQ ID NO: 2322 - protein, 32 aa, Corononavirus-HKU1
STIRIFSNHKSSKRCFFKCTITTYINTNFPTI

SEQ ID NO: 2323 - protein, 89 aa, Corononavirus-HKU1
NMVCNNHSYICDTKPKRHYSTIHNNPLQMHNYTNFRRKIQCYIKIKTSINTCTNRINLKNKKHKKINTPNNNIYNYNTSIISKSTLKFY

SEQ ID NO: 2324 - protein, 29 aa, Corononavirus-HKU1
IIKNQDNNYSQYSSKNRTSSKRKEIYRTN

SEQ ID NO: 2325 - protein, 99 aa, Corononavirus-HKU1
TTKKLIKQIKKISTTKSSRHTSIIIIIQNPGTIKIKTYTLFGVFTCTHSTISHRARSYNTYNTFTNNIRKSYKTIRISKAITCMWNQRCIQRSILHNTI

SEQ ID NO: 2326 - protein, 18 aa, Corononavirus-HKU1
ITIRMWCTITSFKHSTQR

SEQ ID NO: 2327 - protein, 29 aa, Corononavirus-HKU1
NTTTSIKIIIRNLNMWCIALNTITSKCIS

SEQ ID NO: 2328 - protein, 57 aa, Corononavirus-HKU1
NMKAMSQNFSRNIKHSRTDIFIHNCHYNRAIHRIMIVNRPKSGLIPLIKLEKFISKT

SEQ ID NO: 2329 - protein, 30 aa, Corononavirus-HKU1
NISNNTIINNFKTSISRQMNIRLINTICRQ

SEQ ID NO: 2330 - protein, 4 aa, Corononavirus-HKU1
YKTD

SEQ ID NO: 2331 - protein, 4 aa, Corononavirus-HKU1
TNKK

SEQ ID NO: 2332 - protein, 10 aa, Corononavirus-HKU1
QITQYNTSFK

SEQ ID NO: 2333 - protein, 18 aa, Corononavirus-HKU1
KGCCKNRDTCLLLIKSQF

SEQ ID NO: 2334 - protein, 10 aa, Corononavirus-HKU1
LQASFNTCFF

SEQ ID NO: 2335 - protein, 36 aa, Corononavirus-HKU1
ISSKLIKSINKPYTRNISCLSNITLYMLSTILYKNT

SEQ ID NO: 2336 - protein, 9 aa, Corononavirus-HKU1
ISSYNIITL

SEQ ID NO: 2337 - protein, 33 aa, Corononavirus-HKU1
ICRYQIVIIFISKFQTSSYCRYHRFSNKSCFNI

SEQ ID NO: 2338 - protein, 14 aa, Corononavirus-HKU1
INGTTFTYTSHKSI

SEQ ID NO: 2339 - protein, 49 aa, Corononavirus-HKU1
LHTLSKRSMSNVNKIIKTLSINIKMRHKSININIKHSLGYRDTITSCSN

SEQ ID NO: 2340 - protein, 5 aa, Corononavirus-HKU1
LFVYK

SEQ ID NO: 2341 - protein, 5 aa, Corononavirus-HKU1
YRPIQ

SEQ ID NO: 2342 - protein, 33 aa, Corononavirus-HKU1
LCIKHNSIQKISSISITLYYNYIQIRNNFNFRM

SEQ ID NO: 2343 - protein, 7 aa, Corononavirus-HKU1
QIINIYK

SEQ ID NO: 2344 - protein, 32 aa, Corononavirus-HKU1
TSINIIVNTLSISIIEQTHHTTNLLNISNYIM

SEQ ID NO: 2345 - protein, 76 aa, Corononavirus-HKU1
SISWIYRSFKLFRKFYSSFYSYKSVTWFKRMAIKTIPLMFNTKTSTTISSNIIITNYTTNNSTTLNTNTTISFITK

SEQ ID NO: 2346 - protein, 34 aa, Corononavirus-HKU1
TTSFITTIDNMPNKTNYFIHSSNNYIKPQQDKSR

SEQ ID NO: 2347 - protein, 16 aa, Corononavirus-HKU1
HISYKYNKSNQPMHSF

SEQ ID NO: 2348 - protein, 10 aa, Corononavirus-HKU1
HKQIRQPCSK

SEQ ID NO: 2349 - protein, 5 aa, Corononavirus-HKU1
TNKTK

SEQ ID NO: 2350 - protein, 7 aa, Corononavirus-HKU1
WIKPYCV

SEQ ID NO: 2351 - protein, 8 aa, Corononavirus-HKU1
ITNNEFNN

SEQ ID NO: 2352 - protein, 5 aa, Corononavirus-HKU1
TNIIK

SEQ ID NO: 2353 - protein, 42 aa, Corononavirus-HKU1
NTSIYFILNKIYSCICIQHIKTRMTQFTYKTTITKMTCKTYT

SEQ ID NO: 2354 - protein, 100 aa, Corononavirus-HKU1
LRIKITNCNQTKSSLYPHNNSSHKNRKNTNIRKIKVTKNNIYIQKIKPKQKHSGYNKKTFYKYTPSKCLKSIFKSQTKQIKSKLRSYFCSIKNGFIICKM

SEQ ID NO: 2355 - protein, 25 aa, Corononavirus-HKU1
TKNINKQPLQKTIKFYSSCFKNFRN

SEQ ID NO: 2356 - protein, 7 aa, Corononavirus-HKU1
KSLIIIS

SEQ ID NO: 2357 - protein, 20 aa, Corononavirus-HKU1
QIYRYSNRFNTISYIFPNCW

SEQ ID NO: 2358 - protein, 21 aa, Corononavirus-HKU1
QFISNPNNIITTCQIHIPNIN

SEQ ID NO: 2359 - protein, 27 aa, Corononavirus-HKU1
TFNNLNRTIFIINNNSIFYFNSLSNTL

SEQ ID NO: 2360 - protein, 19 aa, Corononavirus-HKU1
LNLFSTNLRFHNRSNHITL

SEQ ID NO: 2361 - protein, 29 aa, Corononavirus-HKU1
LLRYRINRQNTISIFRFKTRFIKISKRIQ

SEQ ID NO: 2362 - protein, 24 aa, Corononavirus-HKU1
CFIMTKPNNRLTKSFTSFKITFHI

SEQ ID NO: 2363 - protein, 29 aa, Corononavirus-HKU1
IIRCQNNITSSYRPDCYFVLNKRQIYIKT

SEQ ID NO: 2364 - protein, 12 aa, Corononavirus-HKU1
LIIQLSTNIMSN

SEQ ID NO: 2365 - protein, 33 aa, Corononavirus-HKU1
LKVSINTVNFSKWFKLSLYNRFCIILTIITIIL

SEQ ID NO: 2366 - protein, 25 aa, Corononavirus-HKU1
KIRVISNHFNIIQKIISQHRCKSLG

SEQ ID NO: 2367 - protein, 8 aa, Corononavirus-HKU1
IFKIQAVS

SEQ ID NO: 2368 - protein, 19 aa, Corononavirus-HKU1
TTTNTCIFFNTTSIIMLVR

SEQ ID NO: 2369 - protein, 24 aa, Corononavirus-HKU1
TTFQMCIMAYTYTHKHVSCNNIIR

SEQ ID NO: 2370 - protein, 40 aa, Corononavirus-HKU1
ILTQRSIRTNQKWYIQFSTMDNSTCTITANLITIKKISLC

SEQ ID NO: 2371 - protein, 24 aa, Corononavirus-HKU1
CTKMHNSINTNTTFLFNTTITNKF

SEQ ID NO: 2372 - protein, 5 aa, Corononavirus-HKU1
FTNCT

SEQ ID NO: 2373 - protein, 14 aa, Corononavirus-HKU1
ISLFQNNTNKISSI

SEQ ID NO: 2374 - protein, 10 aa, Corononavirus-HKU1
WFIKFKMTFS

SEQ ID NO: 2375 - protein, 4 aa, Corononavirus-HKU1
NKSN

SEQ ID NO: 2376 - protein, 58 aa, Corononavirus-HKU1
PMWSASTKFIPCFLPLPFIKFKINMLQHKTSYIHITIIMRLFKRKKWTVNNYRPFTYC

SEQ ID NO: 2377 - protein, 14 aa, Corononavirus-HKU1
KIIISKQLLLIKPK

SEQ ID NO: 2378 - protein, 8 aa, Corononavirus-HKU1
TLYSRNIS

SEQ ID NO: 2379 - protein, 7 aa, Corononavirus-HKU1
RQIFILI

SEQ ID NO: 2380 - protein, 10 aa, Corononavirus-HKU1
NFIGIKITTL

SEQ ID NO: 2381 - protein, 42 aa, Corononavirus-HKU1
LSNINAITENITKYFTKNFTYSKRNRFKINTIYSKQNIYLLS

SEQ ID NO: 2382 - protein, 78 aa, Corononavirus-HKU1
NTNLINSCFIKRTITYITKVFTLTTYINRIRTLKILNSFNTVNNIKFIDKTPIFRKTSHLRQQIITNVIIQLYIMTKQ

SEQ ID NO: 2383 - protein, 8 aa, Corononavirus-HKU1
NFLYNRRI

SEQ ID NO: 2384 - protein, 26 aa, Corononavirus-HKU1
NKTIITTQKKFVCICLKFNNTAYISS

SEQ ID NO: 2385 - protein, 10 aa, Corononavirus-HKU1
SNSQCFSTNN

SEQ ID NO: 2386 - protein, 26 aa, Corononavirus-HKU1
SNLTFLNNIKIFFIITNKDNLFINNT

SEQ ID NO: 2387 - protein, 29 aa, Corononavirus-HKU1
HISRNTKYTSRYESRQTTIIIIKMLISTC

SEQ ID NO: 2388 - protein, 22 aa, Corononavirus-HKU1
QNIRLSSILSSIRAYNIKNCFT

SEQ ID NO: 2389 - protein, 83 aa, Corononavirus-HKU1
FTTGRNITISYLANTFRFNHSSSFFRKFFTCSYSYSFCNSTTMEHMPISRINNNISFNKSSNIYNITFNKTYIRCYTQTIQLR

SEQ ID NO: 2390 - protein, 7 aa, Corononavirus-HKU1
LKRRHTK

SEQ ID NO: 2391 - protein, 58 aa, Corononavirus-HKU1
HSITYYKIKFITTKFSNKLTIYLFITYNSYRMTNVYIHSTCSNKNFFRGAKSTKIVIK

SEQ ID NO: 2392 - protein, 4 aa, Corononavirus-HKU1
VRCY

SEQ ID NO: 2393 - protein, 24 aa, Corononavirus-HKU1
SHIMSTLTNMRHNISIKKQSIQTI

SEQ ID NO: 2394 - protein, 7 aa, Corononavirus-HKU1
IKRKTTF

SEQ ID NO: 2395 - protein, 13 aa, Corononavirus-HKU1
TTPISIRINIKLV

SEQ ID NO: 2396 - protein, 23 aa, Corononavirus-HKU1
KPISKISYKTTLRQNNSFRNSGQ

SEQ ID NO: 2397 - protein, 13 aa, Corononavirus-HKU1
IINKTLIITHLIR

SEQ ID NO: 2398 - protein, 6 aa, Corononavirus-HKU1
PHIFNS

SEQ ID NO: 2399 - protein, 6 aa, Corononavirus-HKU1
ILKLKR

SEQ ID NO: 2400 - protein, 5 aa, Corononavirus-HKU1
FLHYK

SEQ ID NO: 2401 - protein, 13 aa, Corononavirus-HKU1
HRTQPTISMCNSR

SEQ ID NO: 2402 - protein, 28 aa, Corononavirus-HKU1
TINFKICFCFNTRTITNKQSIIIDIIKN

SEQ ID NO: 2403 - protein, 220 aa, Corononavirus-HKU1
KSFISIKVINTFNIIYIITSNNNLVIIVTSNNLFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVINSVFNDTINSIFDSFTTDNVFNILNSKSTIHTRGHCFITSLIK

SEQ ID NO: 2404 - protein, 9 aa, Corononavirus-HKU1
INNILIKFI

SEQ ID NO: 2405 - protein, 16 aa, Corononavirus-HKU1
KCTNLITNHWMLFTRV

SEQ ID NO: 2406 - protein, 24 aa, Corononavirus-HKU1
SILYSITNNSNKIIYSNTLFYFKF

SEQ ID NO: 2407 - protein, 4 aa, Corononavirus-HKU1
TNFT

SEQ ID NO: 2408 - protein, 7 aa, Corononavirus-HKU1
NIIKSRI

SEQ ID NO: 2409 - protein, 35 aa, Corononavirus-HKU1
IKHNLNCHQRRNLHNNRFLVKINFSTCTWKTPSLI

SEQ ID NO: 2410 - protein, 41 aa, Corononavirus-HKU1
KTNIFIIHDNREKFITTLTHVHIIYNTNFFYRFRWLTILIR

SEQ ID NO: 2411 - protein, 32 aa, Corononavirus-HKU1
RRFDILNNIIFYYNRFCNAFKKINLLFLCITW

SEQ ID NO: 2412 - protein, 5 aa, Corononavirus-HKU1
NKTRN

SEQ ID NO: 2413 - protein, 14 aa, Corononavirus-HKU1
PCTNVIKLIAYNTN

SEQ ID NO: 2414 - protein, 11 aa, Corononavirus-HKU1
TINSFKNRHIF

SEQ ID NO: 2415 - protein, 7 aa, Corononavirus-HKU1
NINCNTL

SEQ ID NO: 2416 - protein, 9 aa, Corononavirus-HKU1
LKKSVKFIN

SEQ ID NO: 2417 - protein, 7 aa, Corononavirus-HKU1
NFSIIRY

SEQ ID NO: 2418 - protein, 16 aa, Corononavirus-HKU1
SNKIKVGLRYYKKTIQ

SEQ ID NO: 2419 - protein, 13 aa, Corononavirus-HKU1
LVKKPACSRCTSI

SEQ ID NO: 2420 - protein, 16 aa, Corononavirus-HKU1
HGIKPINHFINKCSTQ

SEQ ID NO: 2421 - protein, 18 aa, Corononavirus-HKU1
LKLSNQPINIMLYIKCSN

SEQ ID NO: 2422 - protein, 10 aa, Corononavirus-HKU1
NSVHKQNTHF

SEQ ID NO: 2423 - protein, 7 aa, Corononavirus-HKU1
THIRNFL

SEQ ID NO: 2424 - protein, 14 aa, Corononavirus-HKU1
KLRHQRCKENTTLN

SEQ ID NO: 2425 - protein, 6 aa, Corononavirus-HKU1
IITTGN

SEQ ID NO: 2426 - protein, 27 aa, Corononavirus-HKU1
KRYKTISTNCKLASKISTTLNKQVNIF

SEQ ID NO: 2427 - protein, 36 aa, Corononavirus-HKU1
KHIIITSIKQQLPTPRIINAKNMILFKITTLTLNII

SEQ ID NO: 2428 - protein, 20 aa, Corononavirus-HKU1
VKCMSNKSSFFNNRFTTYYT

SEQ ID NO: 2429 - protein, 9 aa, Corononavirus-HKU1
INQIIIRLD

SEQ ID NO: 2430 - protein, 42 aa, Corononavirus-HKU1
RFNYRNPQSRTRRPIYTRTKWCDRITIQIKRIMVNSISTISK

SEQ ID NO: 2431 - protein, 9 aa, Corononavirus-HKU1
HRIFRNNTR

SEQ ID NO: 2432 - protein, 24 aa, Corononavirus-HKU1
LGFNFARVINCTTQWTRKTIHHIT

SEQ ID NO: 2433 - protein, 50 aa, Corononavirus-HKU1
NPTIKITIIIKTIYITILHNKTTITQINIIYRFNRKIIHMSHNFHQTRKL

SEQ ID NO: 2434 - protein, 6 aa, Corononavirus-HKU1
NYCISR

SEQ ID NO: 2435 - protein, 37 aa, Corononavirus-HKU1
MYRFTYNYISIYYIFCRLCNIFNTTNSSYSLQAHNKS

SEQ ID NO: 2436 - protein, 39 aa, Corononavirus-HKU1
ITNYMPSHYNIKVTIGKPYRLLLSHILQRIMTISLKTIC

SEQ ID NO: 2437 - protein, 23 aa, Corononavirus-HKU1
FTRIVTTILVYKKYGFNTTILSK

SEQ ID NO: 2438 - protein, 5 aa, Corononavirus-HKU1
SISFL

SEQ ID NO: 2439 - protein, 26 aa, Corononavirus-HKU1
IFTFRLSMNLSISIFYTKIIIIKFKI

SEQ ID NO: 2440 - protein, 53 aa, Corononavirus-HKU1
ITLFNIQPTELKPFVNIRWHKTKRYNPTQKIFTKISSRCSHRKMMYNITFSLV

SEQ ID NO: 2441 - protein, 18 aa, Corononavirus-HKU1
TEQAHNIPFRKTTQAMQR

SEQ ID NO: 2442 - protein, 11 aa, Corononavirus-HKU1
NCRTGLYGCFS

SEQ ID NO: 2443 - protein, 5 aa, Corononavirus-HKU1
NFYNM

SEQ ID NO: 2444 - protein, 11 aa, Corononavirus-HKU1
IFMNKNITDKI

SEQ ID NO: 2445 - protein, 34 aa, Corononavirus-HKU1
LHMPFLSKNAATIYLHMIIINESNTFHRLTSRGA

SEQ ID NO: 2446 - protein, 4 aa, Corononavirus-HKU1
PTLI

SEQ ID NO: 2447 - protein, 40 aa, Corononavirus-HKU1
LHRTSQLLRCIRKQPTKFWRPLEAETVFAGFNHCDLWEGR

SEQ ID NO: 2448 - protein, 15 aa, Corononavirus-HKU1
GQPTRHWQRDEKCGK

SEQ ID NO: 2449 - protein, 4 aa, Corononavirus-HKU1
NTRL

SEQ ID NO: 2450 - protein, 8 aa, Corononavirus-HKU1
LNHTHKHG

SEQ ID NO: 2451 - protein, 13 aa, Corononavirus-HKU1
QGILFKKFRFNEI

SEQ ID NO: 2452 - protein, 5 aa, Corononavirus-HKU1
QEIVS

SEQ ID NO: 2453 - protein, 9 aa, Corononavirus-HKU1
TVRTQFALI

SEQ ID NO: 2454 - DNA, 29942 bp, Corononavirus-HKU1; identical to SEQ ID NO: 1319
  CDS (3)..(29942)

SEQ ID NO: 2455 - protein, 5 aa, Corononavirus-HKU1
FFFFL

SEQ ID NO: 2456 - protein, 32 aa, Corononavirus-HKU1
FLQKAIINFNHILIYILNTTIDSSSRRRLYYS

SEQ ID NO: 2457 - protein, 4 aa, Corononavirus-HKU1
QSNV

SEQ ID NO: 2458 - protein, 5 aa, Corononavirus-HKU1
LIYSL

SEQ ID NO: 2459 - protein, 49 aa, Corononavirus-HKU1
QPTLSVITARIHSDRECPIPNNSEGLPPSVELGFILIKQQSLLHKDHQE

SEQ ID NO: 2460 - protein, 8 aa, Corononavirus-HKU1
QVNYDPQE

SEQ ID NO: 2461 - protein, 12 aa, Corononavirus-HKU1
NHLKCAEYQHLN

SEQ ID NO: 2462 - protein, 9 aa, Corononavirus-HKU1
ESQTVLVIV

SEQ ID NO: 2463 - protein, 7 aa, Corononavirus-HKU1
HLFYAEV

SEQ ID NO: 2464 - protein, 10 aa, Corononavirus-HKU1
NSTNQNQCSD

SEQ ID NO: 2465 - protein, 11 aa, Corononavirus-HKU1
RKHLNSLQELS

SEQ ID NO: 2466 - protein, 11 aa, Corononavirus-HKU1
LSQSLVKYYQT

SEQ ID NO: 2467 - protein, 10 aa, Corononavirus-HKU1
NQNNEVQKHL

SEQ ID NO: 2468 - protein, 9 aa, Corononavirus-HKU1
QVSQPRNLF

SEQ ID NO: 2469 - protein, 4 aa, Corononavirus-HKU1
PSLI

SEQ ID NO: 2470 - protein, 8 aa, Corononavirus-HKU1
NQRKKHLV

SEQ ID NO: 2471 - protein, 6 aa, Corononavirus-HKU1
ELILQE

SEQ ID NO: 2472 - protein, 5 aa, Corononavirus-HKU1
ETEDH

SEQ ID NO: 2473 - protein, 28 aa, Corononavirus-HKU1
YQALTFQHYQNFEKVLFYQNTVEHYNVY

SEQ ID NO: 2474 - protein, 13 aa, Corononavirus-HKU1
EFAFGEVLLKFYA

SEQ ID NO: 2475 - protein, 6 aa, Corononavirus-HKU1
FPWHFA

SEQ ID NO: 2476 - protein, 4 aa, Corononavirus-HKU1
LAEV

SEQ ID NO: 2477 - protein, 10 aa, Corononavirus-HKU1
NLYQAWLKQD

SEQ ID NO: 2478 - protein, 10 aa, Corononavirus-HKU1
RSHQPYQVLL

SEQ ID NO: 2479 - protein, 4 aa, Corononavirus-HKU1
NLNV

SEQ ID NO: 2480 - protein, 22 aa, Corononavirus-HKU1
NYFYLMNDYWVHVIENVNLVDY

SEQ ID NO: 2481 - protein, 21 aa, Corononavirus-HKU1
KQTFLSLQHNSLEAKSYQAET

SEQ ID NO: 2482 - protein, 9 aa, Corononavirus-HKU1
DPLTKHRRE

SEQ ID NO: 2483 - protein, 6 aa, Corononavirus-HKU1
KCQLGD

SEQ ID NO: 2484 - protein, 39 aa, Corononavirus-HKU1
QPRRPLRGIHHRMHWHMGRYRDSRNTISVTTAFVDHQLF

SEQ ID NO: 2485 - protein, 30 aa, Corononavirus-HKU1
KNAGCVYTNILLLQKGVLRKQWELLDHLKI

SEQ ID NO: 2486 - protein, 8 aa, Corononavirus-HKU1
SLYLFEIE

SEQ ID NO: 2487 - protein, 9 aa, Corononavirus-HKU1
SRRTRNNVG

SEQ ID NO: 2488 - protein, 6 aa, Corononavirus-HKU1
YFLVVE

SEQ ID NO: 2489 - protein, 7 aa, Corononavirus-HKU1
VGFFCLY

SEQ ID NO: 2490 - protein, 15 aa, Corononavirus-HKU1
RFGNFAQIGQPKKFS

SEQ ID NO: 2491 - protein, 22 aa, Corononavirus-HKU1
GFLNDFQRSFYFQHNDREYKTS

SEQ ID NO: 2492 - protein, 13 aa, Corononavirus-HKU1
FRFKLLTRQYPYH

SEQ ID NO: 2493 - protein, 8 aa, Corononavirus-HKU1
TVNDSYQL

SEQ ID NO: 2494 - protein, 7 aa, Corononavirus-HKU1
QKQQNHY

SEQ ID NO: 2495 - protein, 17 aa, Corononavirus-HKU1
HLTYLKRHVYRYKVLAP

SEQ ID NO: 2496 - protein, 14 aa, Corononavirus-HKU1
HIRANLKEYNQCQV

SEQ ID NO: 2497 - protein, 9 aa, Corononavirus-HKU1
HPVYKDDHE

SEQ ID NO: 2498 - protein, 8 aa, Corononavirus-HKU1
QLMCDSPQ

SEQ ID NO: 2499 - protein, 10 aa, Corononavirus-HKU1
QTSCLSYQYT

SEQ ID NO: 2500 - protein, 6 aa, Corononavirus-HKU1
DYWSLD

SEQ ID NO: 2501 - protein, 7 aa, Corononavirus-HKU1
NSTNCQF

SEQ ID NO: 2502 - protein, 5 aa, Corononavirus-HKU1
KAEYY

SEQ ID NO: 2503 - protein, 6 aa, Corononavirus-HKU1
QNKESI

SEQ ID NO: 2504 - protein, 13 aa, Corononavirus-HKU1
KMQEKHYSKHKNN

SEQ ID NO: 2505 - protein, 4 aa, Corononavirus-HKU1
SMAT

SEQ ID NO: 2506 - protein, 14 aa, Corononavirus-HKU1
DKQTYYGSYNRTAI

SEQ ID NO: 2507 - protein, 15 aa, Corononavirus-HKU1
KVVLHPKRNSILLRM

SEQ ID NO: 2508 - protein, 5 aa, Corononavirus-HKU1
QLDQK

SEQ ID NO: 2509 - protein, 8 aa, Corononavirus-HKU1
IEEEKIYS

SEQ ID NO: 2510 - protein, 5 aa, Corononavirus-HKU1
CLDLD

SEQ ID NO: 2511 - protein, 24 aa, Corononavirus-HKU1
SGWYNLFTIRLIQLHTSFINVSRR

SEQ ID NO: 2512 - protein, 18 aa, Corononavirus-HKU1
NNKEITKTTKLHTKLNSC

SEQ ID NO: 2513 - protein, 6 aa, Corononavirus-HKU1
KSNNKD

SEQ ID NO: 2514 - protein, 5 aa, Corononavirus-HKU1
RNKTK

SEQ ID NO: 2515 - protein, 12 aa, Corononavirus-HKU1
NLSYVPSSIIEK

SEQ ID NO: 2516 - protein, 5 aa, Corononavirus-HKU1
INHTY

SEQ ID NO: 2517 - protein, 7 aa, Corononavirus-HKU1
VPLHAKQ

SEQ ID NO: 2518 - protein, 8 aa, Corononavirus-HKU1
IQKLIQLI

SEQ ID NO: 2519 - protein, 10 aa, Corononavirus-HKU1
TQPQKQYYHK

SEQ ID NO: 2520 - protein, 16 aa, Corononavirus-HKU1
LQHQNYYYGKYRDYVM

SEQ ID NO: 2521 - protein, 22 aa, Corononavirus-HKU1
SEKQICQTCDTKHLKVQYSNQQ

SEQ ID NO: 2522 - protein, 14 aa, Corononavirus-HKU1
VDSNYTLDTNLQGL

SEQ ID NO: 2523 - protein, 4 aa, Corononavirus-HKU1
HQIL

SEQ ID NO: 2524 - protein, 6 aa, Corononavirus-HKU1
QENVCS

SEQ ID NO: 2525 - protein, 5 aa, Corononavirus-HKU1
VSKRP

SEQ ID NO: 2526 - protein, 8 aa, Corononavirus-HKU1
IKFRFNEI

SEQ ID NO: 2527 - protein, 50 aa, Corononavirus-HKU1
QEILIIMRCFDNKIMMTTILITTIMTFTKTCRTTTSTTTYKKEQYKEYYK

SEQ ID NO: 2528 - protein, 40 aa, Corononavirus-HKU1
PNIPRPFYIHFICTYIFKIDITIIQRLNRLLNKIHLIIQI

SEQ ID NO: 2529 - protein, 9 aa, Corononavirus-HKU1
KSSINSMKI

SEQ ID NO: 2530 - protein, 15 aa, Corononavirus-HKU1
SQIRRNGCLIFKPMR

SEQ ID NO: 2531 - protein, 35 aa, Corononavirus-HKU1
LRFKIRQFWYRMIQINKRRFSKINRTSIHKNNIFI

SEQ ID NO: 2532 - protein, 32 aa, Corononavirus-HKU1
NWFRIIVRTTSEHPMIIMFNKIPLFRCNTYIT

SEQ ID NO: 2533 - protein, 7 aa, Corononavirus-HKU1
YTQTRTY

SEQ ID NO: 2534 - protein, 23 aa, Corononavirus-HKU1
NSFKRNRFITKMHKQQTIRSILN

SEQ ID NO: 2535 - protein, 26 aa, Corononavirus-HKU1
QNMITITTKINTRRLTFNTLINLLHS

SEQ ID NO: 2536 - protein, 19 aa, Corononavirus-HKU1
SSTKFYKRNITKLLRDISI

SEQ ID NO: 2537 - protein, 13 aa, Corononavirus-HKU1
TTINKPINLNLSL

SEQ ID NO: 2538 - protein, 5 aa, Corononavirus-HKU1
SIETR

SEQ ID NO: 2539 - protein, 10 aa, Corononavirus-HKU1
RRTNCTKFIK

SEQ ID NO: 2540 - protein, 71 aa, Corononavirus-HKU1
QTIKCLSIRINNTLYFSKCRVGSTKTILNRKKSIIKSSSYQLLIFIKNIHSNTQTINSILYIKRKWYASCC

SEQ ID NO: 2541 - protein, 57 aa, Corononavirus-HKU1
PWWKHSSNSSGCGVTRNLRFRQNRRQNFNTIKGLYTKKISNFTTTSTIVISFNKTNI

SEQ ID NO: 2542 - protein, 7 aa, Corononavirus-HKU1
KFNFVKQ

SEQ ID NO: 2543 - protein, 14 aa, Corononavirus-HKU1
IFKKRTRRRTAVWT

SEQ ID NO: 2544 - protein, 37 aa, Corononavirus-HKU1
GFKINIINIKMQISIKIGAKCDTLHKSISYMQLSSIK

SEQ ID NO: 2545 - protein, 5 aa, Corononavirus-HKU1
TINFI

SEQ ID NO: 2546 - protein, 12 aa, Corononavirus-HKU1
NTINIITKSAIL

SEQ ID NO: 2547 - protein, 11 aa, Corononavirus-HKU1
VMASCIIRTDK

SEQ ID NO: 2548 - protein, 70 aa, Corononavirus-HKU1
RTINSNFRRISLNKFLLTNYSKVSGNFDLIKTTHRLNTVINKTDIKGFKSNKTIRSRNTSTFTTRRGRRR

SEQ ID NO: 2549 - protein, 21 aa, Corononavirus-HKU1
VIINTKTTTHAKSTRRNRIIS

SEQ ID NO: 2550 - protein, 18 aa, Corononavirus-HKU1
IISIKNATKITIKIWLSS

SEQ ID NO: 2551 - protein, 10 aa, Corononavirus-HKU1
RNIIQNIATF

SEQ ID NO: 2552 - protein, 4 aa, Corononavirus-HKU1
ITIK

SEQ ID NO: 2553 - protein, 82 aa, Corononavirus-HKU1
SQRGSILMKSSRNSSCITRENIICFISNKIFKTNNVAIRIIQKILPTIIINSRNFFKNTLSCNTIKVVINTNISKNFSIRLQ

SEQ ID NO: 2554 - protein, 12 aa, Corononavirus-HKU1
IIRTSGTTIDTI

SEQ ID NO: 2555 - protein, 20 aa, Corononavirus-HKU1
NKIRKNITTVVTDASVIRPT

SEQ ID NO: 2556 - protein, 12 aa, Corononavirus-HKU1
KGISTTKTRNII

SEQ ID NO: 2557 - protein, 40 aa, Corononavirus-HKU1
SIQYTTLFFINTEPCTMFTNTNQRLFLRTRPRVISSYRIR

SEQ ID NO: 2558 - protein, 37 aa, Corononavirus-HKU1
TRTPTPVSVVEYSSTLTRTIISTNRTGSRRWFMTLAT

SEQ ID NO: 2559 - protein, 19 aa, Corononavirus-HKU1
SKRRFSTRTKSIINRKTIT

SEQ ID NO: 2560 - protein, 74 aa, Corononavirus-HKU1
VNNTMRAQIKIIKTIPSIPRRRIIIINSNINCRQTIIQLTRTRSSVNFIIRRLQKTRTAQLQIRSSGVGYGKFI

SEQ ID NO: 2561 - protein, 25 aa, Corononavirus-HKU1
NNTLKTTTIYLRFIKIITRKRISMN

SEQ ID NO: 2562 - protein, 21 aa, Corononavirus-HKU1
TKQSTQIKVAIRKNFTFPIKR

SEQ ID NO: 2563 - protein, 15 aa, Corononavirus-HKU1
GYIKIVKPFINVTIR

SEQ ID NO: 2564 - protein, 17 aa, Corononavirus-HKU1
IRNTTMYSCNRLNSKTR

SEQ ID NO: 2565 - protein, 7 aa, Corononavirus-HKU1
VINTSIR

SEQ ID NO: 2566 - protein, 42 aa, Corononavirus-HKU1
RFSFTLNLAKETTRTINSISNNTTVVKFKKILAFRQRCDPIL

SEQ ID NO: 2567 - protein, 21 aa, Corononavirus-HKU1
SLIISIRRYSITSQRQNIIMR

SEQ ID NO: 2568 - protein, 8 aa, Corononavirus-HKU1
KSTKIQTK

SEQ ID NO: 2569 - protein, 127 aa, Corononavirus-HKU1
KSSRHARISIISIKSATFLIKMKIQPICRNIISKIFLEQTQRFRFIKMPRFITRTTFRFTNSMRILTHSVLTSCNLQNTIMRLNNNSIRVVNKNTTYNYSTKLTIQSFINIQLSILNSRKNTIIKIR

SEQ ID NO: 2570 - protein, 15 aa, Corononavirus-HKU1
KGFLIPKSTQICSTF

SEQ ID NO: 2571 - protein, 14 aa, Corononavirus-HKU1
IPKIGTRFREITSK

SEQ ID NO: 2572 - protein, 4 aa, Corononavirus-HKU1
YSSI

SEQ ID NO: 2573 - protein, 28 aa, Corononavirus-HKU1
INTIKYIICTQTIRNIHNILTYARNCGV

SEQ ID NO: 2574 - protein, 15 aa, Corononavirus-HKU1
IINSKISTIKITYNS

SEQ ID NO: 2575 - protein, 8 aa, Corononavirus-HKU1
CCRQNKNN

SEQ ID NO: 2576 - protein, 31 aa, Corononavirus-HKU1
DLSLYNKNNRKTTKSKAKHNKIPCKIIGKKS

SEQ ID NO: 2577 - protein, 17 aa, Corononavirus-HKU1
TQIGCLIIEDVGHLPKE

SEQ ID NO: 2578 - protein, 13 aa, Corononavirus-HKU1
GQMDVKLSYKNTP

SEQ ID NO: 2579 - protein, 29 aa, Corononavirus-HKU1
YEIQETLYKRPDKIEIKPLSPWLISYLPT

SEQ ID NO: 2580 - protein, 7 aa, Corononavirus-HKU1
LAEELRK

SEQ ID NO: 2581 - protein, 4 aa, Corononavirus-HKU1
QYGN

SEQ ID NO: 2582 - protein, 48 aa, Corononavirus-HKU1
HATDKEISEARSLFHLESTTCTGTNCLDLSKQRALVGKDKKGAVVETL

SEQ ID NO: 2583 - protein, 7 aa, Corononavirus-HKU1
EPGLREI

SEQ ID NO: 2584 - protein, 6 aa, Corononavirus-HKU1
IQSKSG

SEQ ID NO: 2585 - protein, 6 aa, Corononavirus-HKU1
TTLEKP

SEQ ID NO: 2586 - protein, 7 aa, Corononavirus-HKU1
TEPVSML

SEQ ID NO: 2587 - protein, 12 aa, Corononavirus-HKU1
LKLDLKRQSGTK

SEQ ID NO: 2588 - protein, 8 aa, Corononavirus-HKU1
REQPNKVK

SEQ ID NO: 2589 - protein, 4 aa, Corononavirus-HKU1
TSLE

SEQ ID NO: 2590 - protein, 24 aa, Corononavirus-HKU1
LIKIGLLSDKISLLQELNLERETL

SEQ ID NO: 2591 - protein, 7 aa, Corononavirus-HKU1
GISTKVR

SEQ ID NO: 2592 - protein, 11 aa, Corononavirus-HKU1
RKKAILEYKAR

SEQ ID NO: 2593 - protein, 20 aa, Corononavirus-HKU1
NLTLLRSHTSLLPLGKHLNL

SEQ ID NO: 2594 - protein, 7 aa, Corononavirus-HKU1
GLKLTPS

SEQ ID NO: 2595 - protein, 5 aa, Corononavirus-HKU1
SPSPV

SEQ ID NO: 2596 - protein, 4 aa, Corononavirus-HKU1
NRVK

SEQ ID NO: 2597 - protein, 21 aa, Corononavirus-HKU1
KLLKIESPALDEILPLLHKLG

SEQ ID NO: 2598 - protein, 27 aa, Corononavirus-HKU1
SKFLIFKLLIWLQSERLSPNKNQSWFK

SEQ ID NO: 2599 - protein, 10 aa, Corononavirus-HKU1
DTTLRGSLKP

SEQ ID NO: 2600 - protein, 9 aa, Corononavirus-HKU1
KNKKIINIV

SEQ ID NO: 2601 - protein, 20 aa, Corononavirus-HKU1
DLTSIYKTITNKNLFTRIAN

SEQ ID NO: 2602 - protein, 9 aa, Corononavirus-HKU1
FTSFNKRIN

SEQ ID NO: 2603 - protein, 4 aa, Corononavirus-HKU1
LIWS

SEQ ID NO: 2604 - protein, 17 aa, Corononavirus-HKU1
INNSSASQFQRKFSHIK

SEQ ID NO: 2605 - protein, 37 aa, Corononavirus-HKU1
TISTAIPCCTISPKQIVSMHNIAIYFKRRFTQVIYTY

SEQ ID NO: 2606 - protein, 22 aa, Corononavirus-HKU1
KPFTRRSIYISTKNCPKCKTTH

SEQ ID NO: 2607 - protein, 18 aa, Corononavirus-HKU1
ISIPRKLCNFYSYTTTQR

SEQ ID NO: 2608 - protein, 4 aa, Corononavirus-HKU1
FITN

SEQ ID NO: 2609 - protein, 37 aa, Corononavirus-HKU1
MTNVSKKPILTHIIITNIFSKRIIHIRYYQIPMTIKW

SEQ ID NO: 2610 - protein, 9 aa, Corononavirus-HKU1
SHTISKISN

SEQ ID NO: 2611 - protein, 7 aa, Corononavirus-HKU1
TIANKWV

SEQ ID NO: 2612 - protein, 10 aa, Corononavirus-HKU1
IIIYKNTTRW

SEQ ID NO: 2613 - protein, 14 aa, Corononavirus-HKU1
NSRTWSYFFIRPCT

SEQ ID NO: 2614 - protein, 8 aa, Corononavirus-HKU1
NTHINRNS

SEQ ID NO: 2615 - protein, 8 aa, Corononavirus-HKU1
CCSIQILT

SEQ ID NO: 2616 - protein, 22 aa, Corononavirus-HKU1
LSVLSNIHHTACRQINRFTIIP

SEQ ID NO: 2617 - protein, 4 aa, Corononavirus-HKU1
RDSL

SEQ ID NO: 2618 - protein, 58 aa, Corononavirus-HKU1
WNIQILIQNRHRIARFPIISGLHFRIKSHNFIIITPQHKLKILKINININNFTNTTQI

SEQ ID NO: 2619 - protein, 8 aa, Corononavirus-HKU1
LNNRNKII

SEQ ID NO: 2620 - protein, 19 aa, Corononavirus-HKU1
INNCTNTLTTTTLLISNKI

SEQ ID NO: 2621 - protein, 7 aa, Corononavirus-HKU1
MNTRIIL

SEQ ID NO: 2622 - protein, 4 aa, Corononavirus-HKU1
KLLN

SEQ ID NO: 2623 - protein, 9 aa, Corononavirus-HKU1
QIRFFFPTK

SEQ ID NO: 2624 - protein, 26 aa, Corononavirus-HKU1
AYKQMQTSYNFMVKTTINYMIKCIVF

SEQ ID NO: 2625 - protein, 17 aa, Corononavirus-HKU1
TIFSNKQIIIHINKIPF

SEQ ID NO: 2626 - protein, 5 aa, Corononavirus-HKU1
ARFKT

SEQ ID NO: 2627 - protein, 12 aa, Corononavirus-HKU1
QYTTLSKDSKTC

SEQ ID NO: 2628 - protein, 13 aa, Corononavirus-HKU1
SIITNDITRAITT

SEQ ID NO: 2629 - protein, 9 aa, Corononavirus-HKU1
ITLWAPVMA

SEQ ID NO: 2630 - protein, 33 aa, Corononavirus-HKU1
AVCSAEDNIVTIFSHSEPKLNFEFSNFIHNHTI

SEQ ID NO: 2631 - protein, 9 aa, Corononavirus-HKU1
ISSLRTFNH

SEQ ID NO: 2632 - protein, 16 aa, Corononavirus-HKU1
FFSTNKNTISCFSKSF

SEQ ID NO: 2633 - protein, 76 aa, Corononavirus-HKU1
SASVTTIKKYIQIFDELQICVFTNTISGTTKQTIFNIIPQDMLPTNINVQISKNLKFRVVPDTTFCKQFNSYISRK

SEQ ID NO: 2634 - protein, 25 aa, Corononavirus-HKU1
CIIFKNNSIYIINLNNNFVIHNSTR

SEQ ID NO: 2635 - protein, 19 aa, Corononavirus-HKU1
FTCTSIIMTNINQVIYYVF

SEQ ID NO: 2636 - protein, 6 aa, Corononavirus-HKU1
RSKSVP

SEQ ID NO: 2637 - protein, 33 aa, Corononavirus-HKU1
IIKIKILINPKSKACCSNYIIRLKVVTIFFSML

SEQ ID NO: 2638 - protein, 5 aa, Corononavirus-HKU1
TNSST

SEQ ID NO: 2639 - protein, 10 aa, Corononavirus-HKU1
ITPCDTSGAS

SEQ ID NO: 2640 - protein, 9 aa, Corononavirus-HKU1
RNVINLFRF

SEQ ID NO: 2641 - protein, 9 aa, Corononavirus-HKU1
TIYVHTRRI

SEQ ID NO: 2642 - protein, 38 aa, Corononavirus-HKU1
IIEKRHRLKIFKNSSSKRISMECMFINIQTTTITSRKV

SEQ ID NO: 2643 - protein, 9 aa, Corononavirus-HKU1
HSSVKSTNN

SEQ ID NO: 2644 - protein, 14 aa, Corononavirus-HKU1
IRWIFINITIPKHT

SEQ ID NO: 2645 - protein, 14 aa, Corononavirus-HKU1
TIFKIIFMHIIDIK

SEQ ID NO: 2646 - protein, 22 aa, Corononavirus-HKU1
LFNRLGYRKSIIKFKFIIFDTS

SEQ ID NO: 2647 - protein, 9 aa, Corononavirus-HKU1
TFRIAYVIT

SEQ ID NO: 2648 - protein, 5 aa, Corononavirus-HKU1
VVSIT

SEQ ID NO: 2649 - protein, 10 aa, Corononavirus-HKU1
HGSFKHDTLQ

SEQ ID NO: 2650 - protein, 16 aa, Corononavirus-HKU1
PTRCIYTDLIRNYWIL

SEQ ID NO: 2651 - protein, 13 aa, Corononavirus-HKU1
IPINRFTKTIIDC

SEQ ID NO: 2652 - protein, 8 aa, Corononavirus-HKU1
TTSHNCIS

SEQ ID NO: 2653 - protein, 17 aa, Corononavirus-HKU1
RNMCTFMYITNYIVITS

SEQ ID NO: 2654 - protein, 51 aa, Corononavirus-HKU1
RTCITPLLYIYNKWIIHIITSITMAPTTIITSSRIVACSTIRTHITIKLSA

SEQ ID NO: 2655 - protein, 5 aa, Corononavirus-HKU1
FSKIP

SEQ ID NO: 2656 - protein, 19 aa, Corononavirus-HKU1
TSKFKTGRPSNKYYTIRKV

SEQ ID NO: 2657 - protein, 4 aa, Corononavirus-HKU1
KIIR

SEQ ID NO: 2658 - protein, 15 aa, Corononavirus-HKU1
HLNNSNSNNIPLLTF

SEQ ID NO: 2659 - protein, 4 aa, Corononavirus-HKU1
HKGY

SEQ ID NO: 2660 - protein, 24 aa, Corononavirus-HKU1
MFKFFTRRSFSYSFFKSITISLSK

SEQ ID NO: 2661 - protein, 11 aa, Corononavirus-HKU1
ASSFNYKIHTS

SEQ ID NO: 2662 - protein, 49 aa, Corononavirus-HKU1
KTYLQWKVCSNVFASSMSALNIKTNPTSNTFNGFIFSNKQFRITIKSQI

SEQ ID NO: 2663 - protein, 7 aa, Corononavirus-HKU1
FKTHKRY

SEQ ID NO: 2664 - protein, 4 aa, Corononavirus-HKU1
TRIC

SEQ ID NO: 2665 - protein, 6 aa, Corononavirus-HKU1
NRFTNI

SEQ ID NO: 2666 - protein, 15 aa, Corononavirus-HKU1
IYSQIFINLIFIINC

SEQ ID NO: 2667 - protein, 8 aa, Corononavirus-HKU1
GGMRWMIT

SEQ ID NO: 2668 - protein, 17 aa, Corononavirus-HKU1
ATFTTIFKKISCAMQTR

SEQ ID NO: 2669 - protein, 7 aa, Corononavirus-HKU1
SLILNFI

SEQ ID NO: 2670 - protein, 8 aa, Corononavirus-HKU1
SNKIKRFK

SEQ ID NO: 2671 - protein, 33 aa, Corononavirus-HKU1
LHITHNTKNALLGSSYGNIKSININRMGCFCCL

SEQ ID NO: 2672 - protein, 20 aa, Corononavirus-HKU1
IYNIIIFRTLSRIYSLCLNT

SEQ ID NO: 2673 - protein, 25 aa, Corononavirus-HKU1
NTLSNIILTIIRTNKNSTIPNWISF

SEQ ID NO: 2674 - protein, 4 aa, Corononavirus-HKU1
KFTN

SEQ ID NO: 2675 - protein, 9 aa, Corononavirus-HKU1
IYLLNIYST

SEQ ID NO: 2676 - protein, 14 aa, Corononavirus-HKU1
TLMCCLSLKIYFKT

SEQ ID NO: 2677 - protein, 15 aa, Corononavirus-HKU1
TIIIFSLEFIIINQC

SEQ ID NO: 2678 - protein, 20 aa, Corononavirus-HKU1
NSFYNFFRTPITISQKDIRT

SEQ ID NO: 2679 - protein, 14 aa, Corononavirus-HKU1
TTHYFSNRIEVPRF

SEQ ID NO: 2680 - protein, 11 aa, Corononavirus-HKU1
RTLAQQHTWCR

SEQ ID NO: 2681 - protein, 41 aa, Corononavirus-HKU1
LSRISNIYIMFSFNTSIYNRQFIISKHTNFINNNNICNQLW

SEQ ID NO: 2682 - protein, 37 aa, Corononavirus-HKU1
CIYCGKNILTSGIINFKLIITIYTNFSRNNTCTIVNI

SEQ ID NO: 2683 - protein, 29 aa, Corononavirus-HKU1
KLISFFTQCIYSSMTSSSINYTCCVVINS

SEQ ID NO: 2684 - protein, 58 aa, Corononavirus-HKU1
TYSKMRLSRTRGTLNSAITFHSNVLIISNIILKHQWNTINTRKSYTSIVLLWDKCRCT

SEQ ID NO: 2685 - protein, 5 aa, Corononavirus-HKU1
TSYRM

SEQ ID NO: 2686 - protein, 21 aa, Corononavirus-HKU1
NKNITYRKFISSCSAVIHTVS

SEQ ID NO: 2687 - protein, 9 aa, Corononavirus-HKU1
FTFIKNILT

SEQ ID NO: 2688 - protein, 62 aa, Corononavirus-HKU1
NCLTSTSKMVACENIIFIKWWFNFTCLPTQNNFSITNNLLNGSRSIALFKSLFSCLLSFCSK

SEQ ID NO: 2689 - protein, 29 aa, Corononavirus-HKU1
TFNTLICQNIIINFCPFTTSYLIKIIYIR

SEQ ID NO: 2690 - protein, 16 aa, Corononavirus-HKU1
TRARLFIQTKDHTIHN

SEQ ID NO: 2691 - protein, 16 aa, Corononavirus-HKU1
IMGFMVFTIVRHTAQI

SEQ ID NO: 2692 - protein, 16 aa, Corononavirus-HKU1
FGDITHITVRCITNVR

SEQ ID NO: 2693 - protein, 20 aa, Corononavirus-HKU1
DTQNIFMISCHNMVITTFTT

SEQ ID NO: 2694 - protein, 14 aa, Corononavirus-HKU1
QRLTYTTATTQRSL

SEQ ID NO: 2695 - protein, 14 aa, Corononavirus-HKU1
TNNACTYTLHHGTF

SEQ ID NO: 2696 - protein, 6 aa, Corononavirus-HKU1
IHILVK

SEQ ID NO: 2697 - protein, 5 aa, Corononavirus-HKU1
FFSKL

SEQ ID NO: 2698 - protein, 5 aa, Corononavirus-HKU1
TITST

SEQ ID NO: 2699 - protein, 6 aa, Corononavirus-HKU1
NNTITI

SEQ ID NO: 2700 - protein, 14 aa, Corononavirus-HKU1
DLSTKIIIQFFYIF

SEQ ID NO: 2701 - protein, 15 aa, Corononavirus-HKU1
IYTKDFLVFFIFMMY

SEQ ID NO: 2702 - protein, 6 aa, Corononavirus-HKU1
RVSIYS

SEQ ID NO: 2703 - protein, 14 aa, Corononavirus-HKU1
TYKALYQKNTVSLQ

SEQ ID NO: 2704 - protein, 8 aa, Corononavirus-HKU1
IINKTTSS

SEQ ID NO: 2705 - protein, 8 aa, Corononavirus-HKU1
NSRRIWIW

SEQ ID NO: 2706 - protein, 9 aa, Corononavirus-HKU1
INIITIYLN

SEQ ID NO: 2707 - protein, 69 aa, Corononavirus-HKU1
HSMLGTKFMRTISNIIFNPTFRFRHKDIILIVQNLLKNTYISYITLTSIIRVITDNTIITQNHHTKMLT

SEQ ID NO: 2708 - protein, 21 aa, Corononavirus-HKU1
KFIILINKCIINIICTINIRV

SEQ ID NO: 2709 - protein, 4 aa, Corononavirus-HKU1
IAYT

SEQ ID NO: 2710 - protein, 70 aa, Corononavirus-HKU1
IFNLMAITGHKRTNISSNSLTYIKNRISKSSSCITTASTTRLNIIATATHNYFTQNLSTFIRKAIKSITM

SEQ ID NO: 2711 - protein, 10 aa, Corononavirus-HKU1
TTKFMFAGQN

SEQ ID NO: 2712 - protein, 33 aa, Corononavirus-HKU1
TTNNTQNIWHSTITFRIIPTHKNRVVNILYKMT

SEQ ID NO: 2713 - protein, 57 aa, Corononavirus-HKU1
HIVPTTIKFSGSYNNRNTSGSCYTLQTFLMEHSACHSTKNRNTCYSASSILSTDSIF

SEQ ID NO: 2714 - protein, 4 aa, Corononavirus-HKU1
IHLS

SEQ ID NO: 2715 - protein, 18 aa, Corononavirus-HKU1
GGQNITFSICINFILFLK

SEQ ID NO: 2716 - protein, 27 aa, Corononavirus-HKU1
CLIIKSGFTKFIKWITSTFIIIINNNL

SEQ ID NO: 2717 - protein, 17 aa, Corononavirus-HKU1
CWYTTTIINFKIFINNF

SEQ ID NO: 2718 - protein, 8 aa, Corononavirus-HKU1
LLNINHSR

SEQ ID NO: 2719 - protein, 68 aa, Corononavirus-HKU1
IILIIIIISNCSITILSKEKMFQINCTTLFKQAFTFNKLVKVLVKVTWFYSLKFYTTCNGSYTKTTSS

SEQ ID NO: 2720 - protein, 19 aa, Corononavirus-HKU1
IKQSTSRCNVHSRICCIKK

SEQ ID NO: 2721 - protein, 13 aa, Corononavirus-HKU1
IFKRQTITVCVNI

SEQ ID NO: 2722 - protein, 5 aa, Corononavirus-HKU1
VHNYT

SEQ ID NO: 2723 - protein, 29 aa, Corononavirus-HKU1
LFVMVTNRNNKRYTIYKNLSNKGTKTSIR

SEQ ID NO: 2724 - protein, 4 aa, Corononavirus-HKU1
NHTK

SEQ ID NO: 2725 - protein, 35 aa, Corononavirus-HKU1
YIKISTMNNTPIIITIHSIRMILHTPILKILIKQL

SEQ ID NO: 2726 - protein, 20 aa, Corononavirus-HKU1
LVISKIILYKIELSITIINK

SEQ ID NO: 2727 - protein, 43 aa, Corononavirus-HKU1
YMTHSQHRHHIRIVRICNCHTKPWGCLYKITKIIPLTIQILVI

SEQ ID NO: 2728 - protein, 4 aa, Corononavirus-HKU1
TYFN

SEQ ID NO: 2729 - protein, 9 aa, Corononavirus-HKU1
GVCKNDSIK

SEQ ID NO: 2730 - protein, 7 aa, Corononavirus-HKU1
SSIKNRA

SEQ ID NO: 2731 - protein, 37 aa, Corononavirus-HKU1
FFIYINNIRIFNKIIPIFLRKVGFFTISILTKNFTQY

SEQ ID NO: 2732 - protein, 14 aa, Corononavirus-HKU1
TIITIKMTQCIAKI

SEQ ID NO: 2733 - protein, 4 aa, Corononavirus-HKU1
HSIL

SEQ ID NO: 2734 - protein, 42 aa, Corononavirus-HKU1
KIPTNYMWHATTINIKCKEIMFSHNTTTFSQLIISFLFIINF

SEQ ID NO: 2735 - protein, 29 aa, Corononavirus-HKU1
ISSFDNKELIQFITVVIYTLKTATIHFII

SEQ ID NO: 2736 - protein, 14 aa, Corononavirus-HKU1
TYTSSIGITNVKCP

SEQ ID NO: 2737 - protein, 5 aa, Corononavirus-HKU1
LNISR

SEQ ID NO: 2738 - protein, 6 aa, Corononavirus-HKU1
TTSTGY

SEQ ID NO: 2739 - protein, 18 aa, Corononavirus-HKU1
PGIHTSTPNPFKKFKSLD

SEQ ID NO: 2740 - protein, 19 aa, Corononavirus-HKU1
TATLEPTQEQLPSLQKPQT

SEQ ID NO: 2741 - protein, 7 aa, Corononavirus-HKU1
QTSCVNT

SEQ ID NO: 2742 - protein, 32 aa, Corononavirus-HKU1
RIGSFIPKGTCTNLPRNLHIPSTSGCSTRARQ

SEQ ID NO: 2743 - protein, 7 aa, Corononavirus-HKU1
IQTEAPP

SEQ ID NO: 2744 - protein, 19 aa, Corononavirus-HKU1
ESWLIVASGLIVMAIPVPA

SEQ ID NO: 2745 - protein, 17 aa, Corononavirus-HKU1
SQSILTQLIIGTPPCCI

SEQ ID NO: 2746 - protein, 50 aa, Corononavirus-HKU1
VFLGSTENAHNESIEELAAYSVATPACNLIVEDKVPTTHPLAKVLHPLIK

SEQ ID NO: 2747 - protein, 45 aa, Corononavirus-HKU1
RYLILSPLTSCIENLQGGSSSKTTQFPSSFIILVYLRPSTSLRTA

SEQ ID NO: 2748 - protein, 9 aa, Corononavirus-HKU1
TILPLLPLL

SEQ ID NO: 2749 - protein, 19 aa, Corononavirus-HKU1
VGILQFISEPLLTTCIFNL

SEQ ID NO: 2750 - protein, 42 aa, Corononavirus-HKU1
GINSLFCITALATSLYLFAMITRGQLESTLISVNCLLIPSAS

SEQ ID NO: 2751 - protein, 13 aa, Corononavirus-HKU1
TVCICHTLPAYVT

SEQ ID NO: 2752 - protein, 44 aa, Corononavirus-HKU1
TLSTTLSKTCLSGITIVKVLAANAGIALKGTQPLTALSRIEFKA

SEQ ID NO: 2753 - protein, 68 aa, Corononavirus-HKU1
LSNLRTMLKSIVCKAETTLLFLSLIRASLYMLVSARSAIRSSLRATALSRSYTDLAILHAFSNCFICC

SEQ ID NO: 2754 - protein, 38 aa, Corononavirus-HKU1
LTEPLFLASAKFFFATSYSTKLAIFTNSLCKACKTVLS

SEQ ID NO: 2755 - protein, 26 aa, Corononavirus-HKU1
SSLTSSILARHLVSTAAGLANKTINN

SEQ ID NO: 2756 - protein, 53 aa, Corononavirus-HKU1
ASLSKATLKSEVDSISLCKTLQYCHNLELEATCKCCKQFNKTTLAHFTSVNFD

SEQ ID NO: 2757 - protein, 36 aa, Corononavirus-HKU1
IWETSITGTPPIPSSFKFNKIASKLLRGGRKPLAFI

SEQ ID NO: 2758 - protein, 4 aa, Corononavirus-HKU1
TEIL

SEQ ID NO: 2759 - protein, 17 aa, Corononavirus-HKU1
TPIGILKTLFKREKNPQ

SEQ ID NO: 2760 - protein, 9 aa, Corononavirus-HKU1
QDKIYPINK

SEQ ID NO: 2761 - protein, 7 aa, Corononavirus-HKU1
LKRINLI

SEQ ID NO: 2762 - protein, 5 aa, Corononavirus-HKU1
GTSVK

SEQ ID NO: 2763 - protein, 23 aa, Corononavirus-HKU1
NILTDNQLATIFAIANDKIVVHV

SEQ ID NO: 2764 - protein, 39 aa, Corononavirus-HKU1
VPKKAVINNKTSSSKFDPKYHIEIKVTILPTKNIKEKMS

SEQ ID NO: 2765 - protein, 17 aa, Corononavirus-HKU1
LILCIVIKIAKTHKIQP

SEQ ID NO: 2766 - protein, 13 aa, Corononavirus-HKU1
VKFTAGTKYESQT

SEQ ID NO: 2767 - protein, 8 aa, Corononavirus-HKU1
VKPLKPSL

SEQ ID NO: 2768 - protein, 13 aa, Corononavirus-HKU1
NKVQSTGIIYIVK

SEQ ID NO: 2769 - protein, 52 aa, Corononavirus-HKU1
KCLCLTSNIIKLTKQSTHNVTPIICVLIYINIVHLTNAEIIQLNKNVDIKIQ

SEQ ID NO: 2770 - protein, 19 aa, Corononavirus-HKU1
IVSLINLFVLDCNLTPANC

SEQ ID NO: 2771 - protein, 16 aa, Corononavirus-HKU1
TSEGANSSSKVQLPSI

SEQ ID NO: 2772 - protein, 64 aa, Corononavirus-HKU1
NPIYRRLIAANKVSIETPVIEAKASKTRSAFTWLKPFAIAQTLKSSVEQTSFCTNQAQLLSIAA

SEQ ID NO: 2773 - protein, 10 aa, Corononavirus-HKU1
SQAITLTVWT

SEQ ID NO: 2774 - protein, 8 aa, Corononavirus-HKU1
SLTGNCTT

SEQ ID NO: 2775 - protein, 6 aa, Corononavirus-HKU1
ASLYGP

SEQ ID NO: 2776 - protein, 9 aa, Corononavirus-HKU1
KLPVKSVPV

SEQ ID NO: 2777 - protein, 7 aa, Corononavirus-HKU1
QPVLSSN

SEQ ID NO: 2778 - protein, 13 aa, Corononavirus-HKU1
CIYTNLTLSPVNT

SEQ ID NO: 2779 - protein, 15 aa, Corononavirus-HKU1
PTDPHDPHKKEPLIV

SEQ ID NO: 2780 - protein, 6 aa, Corononavirus-HKU1
LLRIVT

SEQ ID NO: 2781 - protein, 29 aa, Corononavirus-HKU1
NAPCGRPLYAAKTVKVSPGLTLPKVYFGV

SEQ ID NO: 2782 - protein, 10 aa, Corononavirus-HKU1
GFCKETVKTS

SEQ ID NO: 2783 - protein, 5 aa, Corononavirus-HKU1
QPCIW

SEQ ID NO: 2784 - protein, 25 aa, Corononavirus-HKU1
DTTVKLIRPDIIVKSPRVTLHNKAE

SEQ ID NO: 2785 - protein, 12 aa, Corononavirus-HKU1
SGSFILEDEHIT

SEQ ID NO: 2786 - protein, 14 aa, Corononavirus-HKU1
TLSSNHKPFKVILP

SEQ ID NO: 2787 - protein, 42 aa, Corononavirus-HKU1
VTLTIQGSIFDVGDTIFTIPDCKKDVETDAVGGWYKTSLPLL

SEQ ID NO: 2788 - protein, 9 aa, Corononavirus-HKU1
LNVSIALAN

SEQ ID NO: 2789 - protein, 6 aa, Corononavirus-HKU1
EHAASL

SEQ ID NO: 2790 - protein, 8 aa, Corononavirus-HKU1
AAVSILPL

SEQ ID NO: 2791 - protein, 11 aa, Corononavirus-HKU1
RYLLYKLKYLL

SEQ ID NO: 2792 - protein, 11 aa, Corononavirus-HKU1
ATSETEFFNLQ

SEQ ID NO: 2793 - protein, 76 aa, Corononavirus-HKU1
ESLVIIKVVRDVSSNVLSLHTLTPIFLQYENNHKTWFAITIATYVTQNQKGIIAPYITIHCKCIITLISEGKYNVT

SEQ ID NO: 2794 - protein, 6 aa, Corononavirus-HKU1
THAQIG

SEQ ID NO: 2795 - protein, 21 aa, Corononavirus-HKU1
KTKSIRKLIHQTTTFITTTLV

SEQ ID NO: 2796 - protein, 10 aa, Corononavirus-HKU1
SPKARLSFIK

SEQ ID NO: 2797 - protein, 32 aa, Corononavirus-HKU1
KTKTTTIANIAPKIELAVREKKSIGRIKLLKN

SEQ ID NO: 2798 - protein, 16 aa, Corononavirus-HKU1
NKSKRSLPQKVPGILL

SEQ ID NO: 2799 - protein, 26 aa, Corononavirus-HKU1
SLFKTQELLKLKHIPSSAYSHAPTLQ

SEQ ID NO: 2800 - protein, 29 aa, Corononavirus-HKU1
VIERVLTIRTIPSLITSGNLIKPLELARL

SEQ ID NO: 2801 - protein, 19 aa, Corononavirus-HKU1
RVCGTKDVYKEAFFITPSE

SEQ ID NO: 2802 - protein, 22 aa, Corononavirus-HKU1
GCGVPSPLLNIVHKDDKTQPLA

SEQ ID NO: 2803 - protein, 4 aa, Corononavirus-HKU1
ICGV

SEQ ID NO: 2804 - protein, 7 aa, Corononavirus-HKU1
TLSLANA

SEQ ID NO: 2805 - protein, 6 aa, Corononavirus-HKU1
VKKCKT

SEQ ID NO: 2806 - protein, 32 aa, Corononavirus-HKU1
KPCLKTLVGTLNIVEPISSSITATTIGQSIEL

SEQ ID NO: 2807 - protein, 9 aa, Corononavirus-HKU1
TDPKVDSYH

SEQ ID NO: 2808 - protein, 29 aa, Corononavirus-HKU1
SNWKNLLAKHKSLTEISLTTPLSITLKLA

SEQ ID NO: 2809 - protein, 4 aa, Corononavirus-HKU1
ISDL

SEQ ID NO: 2810 - protein, 73 aa, Corononavirus-HKU1
TLYVGNKAHNNIKQIKLTKNNIYNKLLNTTPPLSEKGVVRIGTLASCLLKVNFNFKPVLTHAFFNLCCKSAVS

SEQ ID NO: 2811 - protein, 49 aa, Corononavirus-HKU1
LKASINHIQEILAALATLPCTCLAPFCIRTPKSAATILSLFKYVGTKLL

SEQ ID NO: 2812 - protein, 53 aa, Corononavirus-HKU1
FSSVNSKPAATADIIDLVINLVSTSESMEQHLRTHPTKVSKTFSNCTPSLREA

SEQ ID NO: 2813 - protein, 15 aa, Corononavirus-HKU1
AMLTKLLKLFLSTSK

SEQ ID NO: 2814 - protein, 6 aa, Corononavirus-HKU1
DIKVST

SEQ ID NO: 2815 - protein, 32 aa, Corononavirus-HKU1
TSNIVWVTEIPLQAVVINFLSTSNIGLYNDCA

SEQ ID NO: 2816 - protein, 45 aa, Corononavirus-HKU1
NTTAFRKLALSASLSTTTTYKLGTTLTLECNRLLISTNKLASTSS

SEQ ID NO: 2817 - protein, 7 aa, Corononavirus-HKU1
TRCPSLS

SEQ ID NO: 2818 - protein, 15 aa, Corononavirus-HKU1
NKRIIQPTCLISVTT

SEQ ID NO: 2819 - protein, 39 aa, Corononavirus-HKU1
CEASVGFTGRLSSLESSIAASTVIKVLPGLKEWQLKQFH

SEQ ID NO: 2820 - protein, 14 aa, Corononavirus-HKU1
CLTQKPVPPLAVIS

SEQ ID NO: 2821 - protein, 19 aa, Corononavirus-HKU1
RITPPTIVLHLTRTLQFRL

SEQ ID NO: 2822 - protein, 10 aa, Corononavirus-HKU1
QNKQPALLQP

SEQ ID NO: 2823 - protein, 17 aa, Corononavirus-HKU1
TICLIKPTTLYIAVTTI

SEQ ID NO: 2824 - protein, 46 aa, Corononavirus-HKU1
NRNKTKAGNILATNTINLINQCIVSNINKSGNHVVNNCKPIRQNNG

SEQ ID NO: 2825 - protein, 7 aa, Corononavirus-HKU1
NHTVYNE

SEQ ID NO: 2826 - protein, 13 aa, Corononavirus-HKU1
PITSSTINLTKLT

SEQ ID NO: 2827 - protein, 10 aa, Corononavirus-HKU1
SNKTRLSTSY

SEQ ID NO: 2828 - protein, 15 aa, Corononavirus-HKU1
TKSIAAYVSNISKPE

SEQ ID NO: 2829 - protein, 11 aa, Corononavirus-HKU1
HNSHIKLPLQK

SEQ ID NO: 2830 - protein, 9 aa, Corononavirus-HKU1
LVKPTPNLE

SEQ ID NO: 2831 - protein, 30 aa, Corononavirus-HKU1
KSQIVTKPKVAFIHITILPTKIGKTLILGR

SEQ ID NO: 2832 - protein, 34 aa, Corononavirus-HKU1
KSLKITFIYKKLNQNKNTVATTRKPFINILHLNV

SEQ ID NO: 2833 - protein, 21 aa, Corononavirus-HKU1
KAFLRAKQNKLKVNLEAISVV

SEQ ID NO: 2834 - protein, 14 aa, Corononavirus-HKU1
KMVLSFVKCNKLKT

SEQ ID NO: 2835 - protein, 8 aa, Corononavirus-HKU1
INNHFKKP

SEQ ID NO: 2836 - protein, 15 aa, Corononavirus-HKU1
NSIALALKILGTKRV

SEQ ID NO: 2837 - protein, 41 aa, Corononavirus-HKU1
LSSLKHNKSIGIVIGLIPYRIYSLTVGDLTRRDNSLATQTT

SEQ ID NO: 2838 - protein, 86 aa, Corononavirus-HKU1
SQPVKYISQTSTKDKLLTTLIELFSSLTIIASSILTVFLTPFNLTSLVLICDSITEVTTLPCDSSDTESTDKTLYLFSDLKLGLLK

SEQ ID NO: 2839 - protein, 9 aa, Corononavirus-HKU1
VREFNDASS

SEQ ID NO: 2840 - protein, 15 aa, Corononavirus-HKU1
QNQITGLPKVSHPLK

SEQ ID NO: 2841 - protein, 39 aa, Corononavirus-HKU1
RFTYKSSDAKTTSPVATGQTVTLYSTNGKSTLKPNLSFN

SEQ ID NO: 2842 - protein, 12 aa, Corononavirus-HKU1
AQISCPTNLKLV

SEQ ID NO: 2843 - protein, 10 aa, Corononavirus-HKU1
TPSTLANGLN

SEQ ID NO: 2844 - protein, 7 aa, Corononavirus-HKU1
AFIIGFV

SEQ ID NO: 2845 - protein, 6 aa, Corononavirus-HKU1
YLPLSQ

SEQ ID NO: 2846 - protein, 7 aa, Corononavirus-HKU1
YCERSGL

SEQ ID NO: 2847 - protein, 9 aa, Corononavirus-HKU1
ATISTSSKK

SEQ ID NO: 2848 - protein, 34 aa, Corononavirus-HKU1
LVNIDVKVWVKFLRYKQSVKQPLTPVYFLTLQAS

SEQ ID NO: 2849 - protein, 8 aa, Corononavirus-HKU1
GEPHFKCV

SEQ ID NO: 2850 - protein, 49 aa, Corononavirus-HKU1
WPTPTPINMLAATTSSGKSLLRGVLEQIKNGTFNLVQWTILPAQLQPIL

SEQ ID NO: 2851 - protein, 62 aa, Corononavirus-HKU1
PLKRSVFANVPKCITASTPTRLSCLIPQSQISSNSQIAPDKSACFKTTRIKSVASDGSSNLK

SEQ ID NO: 2852 - protein, 43 aa, Corononavirus-HKU1
PLAKTRATNLCGLPARNSYHASCHCHLLNLRLICCNIRQATFT

SEQ ID NO: 2853 - protein, 22 aa, Corononavirus-HKU1
DCSKEKNGPLTTTDHLHTVKKL

SEQ ID NO: 2854 - protein, 5 aa, Corononavirus-HKU1
ASNCC

SEQ ID NO: 2855 - protein, 19 aa, Corononavirus-HKU1
SNPNELCTAEISAKDKFSY

SEQ ID NO: 2856 - protein, 6 aa, Corononavirus-HKU1
YKILSA

SEQ ID NO: 2857 - protein, 53 aa, Corononavirus-HKU1
KSLHFNLVTSMPSQKTLPSILPKTSPTVREIDLKLTPSTVSKTSIFLANKTQT

SEQ ID NO: 2858 - protein, 5 aa, Corononavirus-HKU1
LTVAL

SEQ ID NO: 2859 - protein, 6 aa, Corononavirus-HKU1
KEPSHT

SEQ ID NO: 2860 - protein, 5 aa, Corononavirus-HKU1
PKSLP

SEQ ID NO: 2861 - protein, 36 aa, Corononavirus-HKU1
IELGHSKYLTVLTPLITSNLLIRRQSLGRLVILDNK

SEQ ID NO: 2862 - protein, 10 aa, Corononavirus-HKU1
SRTSLFNCIS

SEQ ID NO: 2863 - protein, 53 aa, Corononavirus-HKU1
RSNKTSCITEEFETKQSSPLKKSLYASVSNLITRPTLAVNLTANALVPTTEVI

SEQ ID NO: 2864 - protein, 22 aa, Corononavirus-HKU1
IISKSSLLLLTRITCLSTTPRR

SEQ ID NO: 2865 - protein, 22 aa, Corononavirus-HKU1
VNDTSAGTLNIPADMRVDKQQS

SEQ ID NO: 2866 - protein, 5 aa, Corononavirus-HKU1
LLRCL

SEQ ID NO: 2867 - protein, 6 aa, Corononavirus-HKU1
ARANKT

SEQ ID NO: 2868 - protein, 26 aa, Corononavirus-HKU1
DCLPSCLASGPTILRIVLHNLPPVET

SEQ ID NO: 2869 - protein, 74 aa, Corononavirus-HKU1
QSPTWQTPLDLTIAAVSLENFLPAATAIAFATPPPWSICPLAGLTITSALTSLATFIISPLTKHTLGVIHKPYN

SEQ ID NO: 2870 - protein, 12 aa, Corononavirus-HKU1
GNSKEDILNDIP

SEQ ID NO: 2871 - protein, 28 aa, Corononavirus-HKU1
PTIKSNLSPLNLVTNLPSICSSPITATE

SEQ ID NO: 2872 - protein, 49 aa, Corononavirus-HKU1
QTFTSTAHAAIKIFLGVQKAQKLSSNNEKCNVQGKSAAIRVILCPHLQT

SEQ ID NO: 2873 - protein, 5 aa, Corononavirus-HKU1
DTISP

SEQ ID NO: 2874 - protein, 33 aa, Corononavirus-HKU1
KNKASKPFKSKEKPHFKQHQLAYALISNWFKNQ

SEQ ID NO: 2875 - protein, 8 aa, Corononavirus-HKU1
AKSATKPP

SEQ ID NO: 2876 - protein, 12 aa, Corononavirus-HKU1
GKTIALGIVVSK

SEQ ID NO: 2877 - protein, 4 aa, Corononavirus-HKU1
STKL

SEQ ID NO: 2878 - protein, 52 aa, Corononavirus-HKU1
DNHIFSIAKSLNLKGNFCITSNTERNQQLVCVIVGDHKPLTLKYVSVSTLEP

SEQ ID NO: 2879 - protein, 7 aa, Corononavirus-HKU1
LTNKASL

SEQ ID NO: 2880 - protein, 9 aa, Corononavirus-HKU1
TSLKTKRAL

SEQ ID NO: 2881 - protein, 4 aa, Corononavirus-HKU1
VSKS

SEQ ID NO: 2882 - protein, 212 aa, Corononavirus-HKU1
ILSISSTSSPVTTIWSSLSPVTISSSLLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLIVSSTTPSIVSSTASLLITSSTSSIAKVQYIREAIASSPASSNK

SEQ ID NO: 2883 - protein, 13 aa, Corononavirus-HKU1
TTFSLSLFKNART

SEQ ID NO: 2884 - protein, 82 aa, Corononavirus-HKU1
PTTGCSLQEFKAFSIASQTTATKSSTVTPFSTSNSEQTLPKISSKVESKSNITLTVIKDGISITTGFSLKLTFLPAHGKRQA

SEQ ID NO: 2885 - protein, 37 aa, Corononavirus-HKU1
SKRQIFLSFMTIGKNLSPHLPMYILSIIQIFSTDLGG

SEQ ID NO: 2886 - protein, 25 aa, Corononavirus-HKU1
DDKEDLTFSITSSSTITDSATPSKK

SEQ ID NO: 2887 - protein, 21 aa, Corononavirus-HKU1
ICCSCALHGKTKPGINPVLTL

SEQ ID NO: 2888 - protein, 35 aa, Corononavirus-HKU1
NLLPTIQTKPLIVLRTGISFKTSTVTHSNNNLKKV

SEQ ID NO: 2889 - protein, 8 aa, Corononavirus-HKU1
NLLTKILA

SEQ ID NO: 2890 - protein, 11 aa, Corononavirus-HKU1
SGIKATKLKLA

SEQ ID NO: 2891 - protein, 10 aa, Corononavirus-HKU1
DTTKRPFNNW

SEQ ID NO: 2892 - protein, 31 aa, Corononavirus-HKU1
RSQPVAGALASNMVLNQLTILLTSVVPNNLN

SEQ ID NO: 2893 - protein, 6 aa, Corononavirus-HKU1
VTNLLT

SEQ ID NO: 2894 - protein, 25 aa, Corononavirus-HKU1
NVATETLSINKIHIFKHISETSCEN

SEQ ID NO: 2895 - protein, 10 aa, Corononavirus-HKU1
DIKDVKKIPL

SEQ ID NO: 2896 - protein, 40 aa, Corononavirus-HKU1
LRGIKPSSKKGTKPSPQTANLQAKSARRLTNKSIFFRSIL

SEQ ID NO: 2897 - protein, 18 aa, Corononavirus-HKU1
SPLLSNSCLHQELLTPRI

SEQ ID NO: 2898 - protein, 9 aa, Corononavirus-HKU1
FCSRLPHLH

SEQ ID NO: 2899 - protein, 17 aa, Corononavirus-HKU1
VIRAVSLTIDLQPTTPE

SEQ ID NO: 2900 - protein, 4 aa, Corononavirus-HKU1
TKSS

SEQ ID NO: 2901 - protein, 28 aa, Corononavirus-HKU1
DLTEDLIIGIHNPGRGDQYIQEPNGVTE

SEQ ID NO: 2902 - protein, 36 aa, Corononavirus-HKU1
PYKLKESWLTVSVLLVNNTGFSGITPDDWALTSLES

SEQ ID NO: 2903 - protein, 19 aa, Corononavirus-HKU1
TVQHNGQEKPSIILPETQP

SEQ ID NO: 2904 - protein, 10 aa, Corononavirus-HKU1
KSQLSLKQST

SEQ ID NO: 2905 - protein, 24 aa, Corononavirus-HKU1
PYCITKPQSHKSTLYIDLIEKSSI

SEQ ID NO: 2906 - protein, 86 aa, Corononavirus-HKU1
VITFIKLGSFKTIASADNKCTGSRITTSPSTTSSVGCATYLIPQIVAIVCRRITNRESRTTCQATTISKSQLASHTDCFCLISCKE

SEQ ID NO: 2907 - protein, 8 aa, Corononavirus-HKU1
RQSANLPE

SEQ ID NO: 2908 - protein, 21 aa, Corononavirus-HKU1
SQPYWSTKSTGLIPRYCLSKA

SEQ ID NO: 2909 - protein, 11 aa, Corononavirus-HKU1
AFCEYLPLGSA

SEQ ID NO: 2910 - protein, 7 aa, Corononavirus-HKU1
ASSTLKS

SEQ ID NO: 2911 - protein, 20 aa, Corononavirus-HKU1
SSNLKFEIIKSLSSIYNLQN

SEQ ID NO: 2912 - protein, 26 aa, Corononavirus-HKU1
DGIKPKGTIQPKKSSPKLVVDVVIER

SEQ ID NO: 2913 - protein, 48 aa, Corononavirus-HKU1
RLVLYERNKPITYPLGKPPKLCKGDLIKIAVPDFTAVLVRTSTTCRSS

SEQ ID NO: 2914 - protein, 25 aa, Corononavirus-HKU1
TKISRIRFDCTCHSCPRMQRQSIFT

SEQ ID NO: 2915 - protein, 8 aa, Corononavirus-HKU1
TNPTLSIA

SEQ ID NO: 2916 - protein, 73 aa, Corononavirus-HKU1
PVEGHNPPSSDFIGLANSSAASGSSQRNSGAHLKPRPYLLVLIIATYGRDAEDNQHVTGREMKSVESKIQDYD

SEQ ID NO: 2917 - protein, 25 aa, Corononavirus-HKU1
TTLTSMDNRESCLKSLDLMRSDKRS

SEQ ID NO: 2918 - protein, 12 aa, Corononavirus-HKU1
ADRRYGRNSLLF

SEQ ID NO: 2919 - DNA, 29836 bp, Corononavirus-HKU1
  modified_base (29514): a, c, g, t, unknown, or other
gaataagagcgaattgcgtccgtaccgtctatcagcttacgatctcttgtcagatctcattaaatctaaactttttaaacaagattccctgttatccatgcttgtgagtgtggtttaatcataatcttgtattttactttccacacttttcatctctctgccagtgacgtgttggttgtcctcagcgtccctcccataggtcgcaatgattaaaaccagcaaatacggtctcggcttcaagtgggcgccagaatttcgttggctgcttccggatgcagcggaggagttggctagtcctatgaagtcagatgagggtgggttatgcccctctactggtcaagcgatggaaagtgttggatttgtttatgataatcatgtgaagatagattgtcgctgcattcttggacaagaatggcatgtgcagtcaaatcttatccgtgatatttttgttcatgaagatctacatgttgtagaagttctaactaaaacagccgtaaagtccggtacggcaattttaattaaatcacctttgcatagcttgggtggttttcctaaagggtatgttatgggcttgttccgttcatacaagactaaacgttatgttgtacatcatctttctatgactacatctactactaattttggtgaagattttttgggttggattgtaccttttggttttatgccatcttatgttcacaaatggtttcaattctgtaggttgtatattgaagagagtgatttaataatttcaaattttaaatttgatgattatgattttagtgtagaagatgcttatgctgaggttcatgctgagcctaaaggtaaatattcacaaaaagcttatgctttacttagacaatatcgtggtattaaacccgtactctttgtagaccagtatggttgtgactattctggtaaattagcagattgtcttcaagcttatggtcattattctttgcaagatatgagacaaaagcagtctgtatggcttgccaattgcgactttgatattgtagtggcttggcatgtagttcgtgattcacgatttgttatgcgcctgcagactatagctactatttgtggtattaaatatgttgcacaacctacagaagatgtagtagatggagctgtagttatacgtgaacctgtacatttattatctgctgatgcaatagttttaaagcttcctagtttgatgaaagttatgactcatatggatgatttttctattaaatctatatacaatgttgatttgtgtgattgtggttttgttatgcagtatggttatgtagattgttttaatgataattgtgatttttatggttgggtttcaggtaatatgatggatggtttttcttgtccattgtgttgtacagtttatgactctagtgaagttaaagcccaatcatctggtgttattcctgagaatcctgtgttatttactaatagtactgatactgttaaccctgattcttttaatttgtatggttattctgttacaccatttggttcttgtatatattggtcaccgcgtcctggattgtggattcctatcattaaatcttcagtcaagtcttatgatgatttggtttattcaggtgtagtaggttgtaaatctattgttaaagaaactgctcttattactcatgcactttacttagattatgttcaatgtaagtgtggtaatcttgaacaaaatcatattcttggtgttaataattcttggtgtaggcaactgttgcttaatagaggtgattataatatgcttttaaaaaatattgacttgtttgttaagcgtcgtgctgattttgcttgcaagtttgcagtttgtggagatggttttgtaccttttttactagatggtttaattccccgtagttattatctaattcagagtggtattttctttacatctttgatgtctcaattttcacaagaagtttctgatatgtgtttaaaaatgtgtattttgtttatggacagagtttcagttgctacattttatatagagcattatgttaataggttggttactcaatttaagttattgggtactacacttgttaataaaatggttaattggtttaataccatgttagatgctagtgcacctgctacaggctggcttctttaccaattattgaatggtctttttgtagtatctcaagccaactttaattttgttgctttaatacctgattatgctaaaattttagttaataaattttacactttttttaagttattattagagtgtgttacagttgatgttttaaaagatatgcctgttcttaaaactattaatggtttagtttgtattgtaggcaataagttttataacgttagtacagggttaattcctggttttgttttaccatgtaatgcacaggaacaacaaatttatttttttgaaggcgttgcagaatctgttatagtagaagatgatgttattgagaatgtcaaatcttctttatcatcttatgagtattgtcaaccacctaaatctgtagaaaaaatttgtattatagataatatgtacatgggtaagtgtggtgataaatttttccctattgtcatgaatgataaaaatatttgtcttttagatcaggcttggcgttttccatgtgcaggtagaaaagttaattttaacgagaaacctgttgttatggagattccgtctttgatgacagttaaggttatgtttgatttagattctacttttgatgatattttaggtaaagtttgttcagaatttgaagtagaaaagggtgttactgtagatgattttgtcgctgttgtttgtgatgctatagagaatgctttaaactcttgtaaagatcatccagtggttggttatcaagttcgtgcatttttaaataaacttaatgagaacgttgtttatttatttgatgaggctggtgatgaagcaatggcctctcgtatgtattgtacttttgctattgaggatgttgaagacgttatcagtagtgaagctgttgaagatactattgatggtgtcgttgaagacactattaatgatgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgataatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagagattgttactggtgacaatgatgaccaaattgttgttactggtgatgatgtagatgatattgaaagtgtctatgattttgatacttataaagctcttttagtttttaatgatgtctataatgatgctttgtttgttagttatggttctagtgttgaaacagaaacatattttaaagttaatggtttatggtcacctactattacacatactaactgttggttgcgttctgtgttacttgtaatgcagaaattaccttttaagtttaaggatttagctattgaaaatatgtggttatcttataaggtgggttataatcaaagttttgttgattatttactgaccactattcctaaagctattgttttgcctcaaggtggttatgtagctgactttgcttattggtttttaaaccagtttgatattaatgcgtatgctaattggtgttgtttaaaatgtggtttttcttttgatttaaatggtttggatgctgtgtttttttatggagatattgtgtctcatgtttgtaagtgtggacataatatgactctaatagcagcggacttaccttgtacattacatttttcattatttgatgacaatttttgtgctttttgcacccctaaaaaaatttttattgctgcatgtgctgtggatgtaaacgtttgtcattctgtagctgttataggtgatgaacaaatagatggtaagtttgttactaaatttagtggtgataaatttgattttatagtaggttatggaatgtcatttagtatgtcttcttttgagttagctcaattgtatggtttgtgtataacacctaatgtatgttttgttaaaggtgatattataaatgttgctagacttgttaaagctgatgttattgttaaccctgctaatgggcatatgctccatggtggtggagttgcaaaagctatagctgtagctgcaggtaaaaaattttctaaagaaactgctgctatggttaaatctaaaggtgtttgccaagtaggagattgttatgtttctaccggtggtaaattatgtaaaacaattcttaatattgtaggtcctgatgctagacaagatggaagacaatcttatgttttgttagcacgtgcttataagcatcttaataattatgattgttgtttgtctactctcatatcggctggtatatttagtgttcctgctgatgtgtcattaacttaccttctaggtgttgttgataaacaagttatccttgttagtaataataaagaagattttgatattattcaaaaatgtcaaattacttcagttgttggtactaaagcattggctgttagattaactgctaatgtaggccgtgttattaaatttgagacagatgcatacaaacttttcttgagtggtgatgattgttttgtttcaaattcttctgttatacaagaagttttattgcttcgtcatgatatacaattgaataatgacgttcgtgattatttgttgtctaagatgactagtcttcccaaagattggcgtcttatcaataaatttgatgttattaacggtgttaaaactgttaagtactttgagtgtcctaattctatttatatatgtagtcagggtaaagactttggttatgtatgtgatggttctttttataaagcaactgttaatcaagtttgtgtgttattagctaagaagatagatgttttgcttactgtagatggtgttaattttaaatctatttctcttactgtaggtgaagtttttggtaaaatacttggtaatgttttctgtgatggcattgatgttactaagttaaagtgtagtgatttttatgccgataaaattttatatcagtatgaaaatttgtctttagctgatatttctgctgtacaaagttcatttgggtttgatcagcaacaattgcttgcttactataattttttaacagtatgtaaatggtctgtagttgttaacggtccatttttttcttttgaacagtctcataataattgttatgtgaatgtagcttgtcttatgttgcagcatattaatcttaaatttaataaatggcagtggcaggaagcatggtatgaatttcgtgctggcagaccacataggttagttgctcttgttttagctaaaggtcattttaaatttgatgaaccatcagatgctactgattttattcgtgttgttttgaaacaagctgatttatcaggtgcaatttgtgaattagaacttatttgtgattgtggtattaaacaagaaagtcgtgttggtgttgatgctgttatgcattttggtacattagcaaagactgatctttttaatggttataagattggctgtaattgtgcaggtagaattgtccattgtactaaattgaatgtaccatttttgatttgttctaatactcctctgagtaaggatttacctgatgatgttgttgcagctaacatgtttatgggtgtaggtgtaggccattatacacatttgaaatgtggttcaccttaccaacattatgatgcttgtagtgttaaaaaatatacaggtgttagtggttgtttaactgactgcttgtatcttaaaaatttaacccagacttttacatctatgttgactaattattttttggatgatgttgaaatggttgcttataaccctgatctttcacaatattattgtgataatggtaagtattatacaaaacctattataaaggctcagtttaaaccatttgctaaagttgacggtgtttatactaactttaagttagttggacatgatatttgtgctcaattgaatgataagttaggttttaatgtagatttgccgtttgttgagtacaaagtaacagtctggcctgtagctactggtgatgttgttttggcatctgatgatttatatgttaaacgttattttaaaggatgtgaaacttttggtaagcctgttatttggctttgtcatgatgaagcatcattgaattctcttacttattttaataaacctagttttaaatctgaaaatagatatagtgttttgtctgttgattctgtatctgaggagtcacaaggtaatgtggttacttctgttatggaatcgcagattagtactaaagaggttaagttaaagggtgttagaaagactgttaaaatagaagatgctattattgttaatgatgaaaatagttctattaaggttgttaaaagtttatctttagttgatgtttgggatatgtatttgacaggttgtgattatgttgtttgggttgctaatgaattgtcacgcctagttaaatcaccaacagttagggaatatatacgatatggtattaaacctattactatacctatagatttgttatgtttaagagatgataatcaaactcttttagttcctaaaatttttaaagcaagagctatagaattttatggttttttgaagtggttgtttatttatgtttttagtttattacattttacaaatgataaaaccattttttatactacagaaatagcttctaagtttacttttaatttgttttgtttggctcttaaaaatgcttttcagacatttagatggagtatatttataaaaggttttcttgttgtagccactgtgtttttgttttggtttaattttttgtatataaatgttatttttagtgatttttatcttcctaatattagtgtttttcctatttttgtgggaagaattgttatgtggataaaggctacttttggtttggttacaatttgtgatttttattctaagttaggtgtaggttttacaagtcatttttgtaatggtagttttatatgtgaattgtgttattctggttttgatatgttggatacatatgcagctatagattttgttcagtatgaagtagatagacgtgttttatttgattatgttagtttagtcaaattaattgttgaactcgttattggttattcattatatacagtatggttttatccattattttgtcttattggtttacaattatttactacatggttgcctgatttgtttatgttagaaactatgcattggttgattagatttattgtatttgtagctaatatgttacctgcttttgtcttgttgcggttttatatagttgttactgctatgtataaagtagttggttttattaggcatattgtttatggttgtaataaagctggttgtttgttttgttataaacgaaattgtagtgttcgtgttaagtgtagtactattgttggtggtgtaattcgttattatgatattactgctaatggtggtactggtttttgtgttaaacatcaatggaattgttttaattgccattcttttaaaccaggtaacacttttataactgtagaagctgctatagaactttctaaagagcttaaacgacctgtaaacccaactgatgcttcacattatgtagttactgatattaagcaagttggttgtatgatgcgtttgttctatgatagagatggacagcgtgtttacgatgatgttgatgctagtttatttgtagatattaataatctgttacattctaaagtcaaagttgttcctaatttgtatgtagttgtagtagagagtgatgctgatagagctaattttctgaatgctgttgtgttttatgcacaatcattgtataggcctatattacttgtagacaaaaagttaattactacagcttgtaatggtatctctgtaacccagactatgtttgatgtttatgttgatacttttatgtctcattttgatgttgatagaaagagttttaataattttgttaacattgctcatgcttctcttagagagggtgtgcaattagaaaaggttttagatacttttgtgggatgtgtacgtaaatgttgttccattgattcagatgttgaaacaagatttattactaaatctatgatatctgcagtagctgctggtttggaatttactgatgaaaattataacaatttggtacctacatatttaaagagtgataatattgtagctgcagatttaggtgttcttatacagaatggtgctaagcatgtacagggtaatgttgctaaggcagctaatatttcttgtatatggtttattgacacttttaatcaacttactgctgatttacagcataaattaaaaaaagcatgtgttaaaactggcttgaagttaaaattgacttttaataagcaagaggcaagtgttcctattcttacaacgcccttttcacttaaaggaggtgttgtattgagtaatttgttatatatattattttttattagtttaatctgttttatattattgtgggctttactgcctacatatagtgtttataagtctgatattcatttgcctgcttatgctagttttaaagttattgataatggtgttgttagagatatttcagttaatgatttatgttttgctaataaatttttccaatttgatcaatggtatgagtccacttttgggtctttttactatcataattctatggattgccctattgttgtggcagttatggatgaagatattggttctactatgtttaatgttcctactaaagttttgagacatggctttcatgttttacattttctaacttatgcatttgctagtgatagtgttcagtgctatacaccacatattcagatttcttataatgatttttatgctagtggttgtgttttatcatctttgtgtactatgtttaaaagaggtgatggtacaccacatccttattgttattcagatggtgttatgaagaatgcttctttgtatacatctttggttccacatacacgttatagccttgctaattctaatggttttataagatttcctgatgttattagtgaaggtattgtacgtattgtaagaacgcgctctatgacttattgtagagtgggtgcatgtgaatatgccgaagagggtatatgttttaattttaatagttcctgggttttgaataatgattattatagaagtatgcctggaactttttgtggtagagatctttttgatttgttttatcaattttttagtagtttaattcgtcctatagatttcttttctcttactgctagttctatttttggagctatattggctatagtcgttgtcttggttttttattatttaataaaacttaagcgtgcttttggagattatactagtgttgtagttataaatgttattgtttggtgtattaattttcttatgctttttgtttttcaagtttatcctatttgtgcatgtgtctatgcttgtttttatttttatgtaacattgtattttccttctgaaattagtgtaattatgcatttgcaatggattgttatgtatggtgctataatgcctttttggttttgtgtcacatatgtagctatggttattgcaaaccatgttttatggttattttcatattgtaggaaaattggtgttaatgtatgtaatgatagtacatttgaagaaacatctcttactacttttatgattactaaagattcttattgtagattaaagaattctgtttctgatgttgcttacaatagatatttgagtttgtataataagtatcgttactatagtggtaaaatggatactgctgcctatagagaagcggcgtgttctcagttagctaaagctatggaaacatttaatcacaataatggtaatgatgtcttataccaacctcctacagcatctgtttctacatcttttttgcaatcaggtattgtaaagatggtatctcctacgtcaaaaattgaaccttgtattgttagtgttacttatggtagtatgactttgaatggtttatggttagatgacaaagtttattgtcctcgtcatgttatatgtttatcctctaatatgaatgaacctgattattctgccttattatgtagagttactctaggtgattttactataatgtctgggcggatgagtttaacagttgtgtcttaccagatgcagggctgtcaacttgttttgacagtctctttacaaaatccttacactccaaaatatacttttggtgttgttaaacctggtgaaacttttactgttttagctgcgtataatggccgaccacaaggggcatttcatgttactatgcgtagtagttatactattaaaggttcttttttgtgtgggtcatgtggatctgttggttatgtattaacaggtgatagtgttaagtttgtatatatgcatcaattagagctcagtactggttgtcacactggcactgattttactggtaatttttatggtccatatagagatgctcaagttgtacagttgccagttaaggactacgtccaaactgttaatgttattgcttggctctatgcagctatacttaataattgtgcttggtttgtacaaaatgatgtttgttctattgaagattttaatgtttgggctatgacaaatggttttagccaagtaaaagcagatcttgttttagatgctttggcttcaatgacaggtgtttctattgaaactttattggctgctattaagcgtctatatatgggatttcaaggtcgtcaaatactaggaagttgtacttttgaagatgaattggcaccttctgacgtttatcaacaattggctggtgttaaattgcaatctaaaacaaaaagatttattaaagaaacaatttattggattttgatatctacatttttgtttagttgtataatttctgcatttgttaaatggactatatttatgtatattaatacacatatgattggtgttacattatgtgtactttgttttgttagttttatgatgttactagttaaacataagcatttttatttgactatgtatataattcctgtactctgtaccttgttttatgtaaattatttagttgtctataaggaaggttttagaggtcttacttatgtctggctctcatattttgttcctgctgtgaattttacttatgtttatgaagtattttatggttgtattttatgtgtttttgctatttttataactatgcatagtattaatcatgacattttttctttgatgtttttggttggtagaatagttactttaatttctatgtggtattttgggtcgaatttagaagaggatgttttgttatttattacagcctttttaggtacttatacatggaccactattttgtcattagctatagcaaaaattgttgctaattggttgtctgttaatatattttattttacagatgtaccttatattaaattgattcttttgagttacttatttatagggtatattttatcttgttattggggatttttctctcttttaaacagtgtttttagaatgcctatgggtgtttataattataaaatttctgttcaagaattgcgttatatgaatgctaatggcttacgtccaccccgtaatagttttgaggctattttgttaaatttaaaactgcttggaataggtggcgtgccagttattgaagtttctcaaattcaatcaaaattgactgatgtgaaatgtgctaatgttgttttgttaaattgtttacagcatttgcatgttgcttctaattctaggttgtggcagtattgtagtattttacataatgaaatactatctacttcagatttaagtgtagcttttgataagcttgctcaattattgattgttttattcgccaatcctgctgcagttgatactaagtgtcttgcaagtatagatgaagttagcgatgattatgttcaagatagtactgttttgcaggctttgcaaagtgagtttgtaaatatggctagttttgttgaatatgaagtcgcaaagaaaaatttggctgatgctaaaaatagtggttctgttaatcaacaacagataaaacagttagaaaaggcatgtaatatagctaagtctgtgtatgaacgcgataaagctgtagctcgcaaactggaacgtatggcagacctagcacttactaacatgtataaagaggctcggattaatgataagaagagtaaagttgtttccgctttgcagacaatgctttttagcatggttcgtaaattggataatcaggctttaaattctattctggataatgctgttaaaggttgtgtacctttgaatgctattccagcgctggctgctaatactttaactataataataccagataaacaagtttttgataaagttgttgataatgtttatgttgcatatgctggtagtgtatggcatatacagactgttcaagatgctgatggtattaataaacagttaactgatattagtgttgattctaattggcctcttgttattattgctaacaggtataatgaagttgctaatgctgttatgcagaataatgagttgatgcctcataaattaaaaatacaagttgttaatagtggttctgatatgaattgtaacattcctactcaatgttattataataatggtagtagtggtagaatagtttatgctgttcttagtgatgttgatggtcttaagtatactaagataataaaagatgatggaaattgtgttgttttagagcttgatcctccttgtaaattttctatacaagatgttaagggacttaaaattaagtatctttattttattaaaggatgtaacactttagctagagggtgggttgttggtactttatcttcaacaattagattgcaggctggtgttgctactgagtatgcagctaattcttctatactttcattatgtgcattttctgtagatcctaagaaaacttatttagattatatacaacaaggtggtgtacctataattaattgtgttaaaatgctctgtgatcatgctggtactggtatggctattactattaaacctgaggctactattaatcaagattcttatggtggtgcctcagtttgtatttactgccgtgcacgtgtagagcatccagatgtagatggtttgtgtaaattacgtggtaaatttgtacaagtccctttgggtataaaagatcctattctctatgtgttaacacatgatgtttgtcaagtttgtggattttggagagatggcagttgttcctgtgtaggttcaggtgtcgctgttcaatctaaagatttaaattttttaaacgggttcggggtactagtgtgaatgcccgtctagtaccctgtgctagtggtttatctactgatgttcaattaagggcatttgatatttgtaatactaatagagctggtataggtttatattataaagtgaattgttgccgttttcagcgtatagatgacgacggtaataaattggataagttctttgttgttaaaagaactaatctagaagtttataataaagagaaaacttattatgagttgactaaaagttgtggtgttgtggctgaacatgatttctttacatttgatattgatggtagtcgtgtgccacatatagttcgtaagaacctctcaaagtatactatgttagatctttgctatgcattgcgccattttgattgtaatgattgttcagtattgtgtgaaattctttgtgagtatgctgattgtaaagaatcctacttttctaagaaagattggtatgattttgttgaaaatcctgatattattaatatttataaaaaattaggccctatttttaatagagctttacttaatactgtcagttttgcagatactttagtaaaagtaggtttagttggtgttttaactttagataatcaagacttgtatggtcaatggtatgattttggtgattttatacaaacagctccaggttttggtgtggcagttgcagattcttactattcttatatgatgcctatgttgactatgtgtcatgtattagattgtgaattatttgttaatgatagttatagacaattcgatcttgtacagtatgattttactgattataagttagaattgtttaataagtattttaagtattggggtatgaagtatcatcctaatactgtggattgtgataatgataggtgtattattcattgtgctaattttaatatattatttagtatggtcttacctaatacttgttttggtcctcttgttagacaaatttttgtagatggtgttccgtttgttgtttcaattggttaccattataaagagttaggtgtagttatgaacttggatgttgatacacaccgctatcgtttgtctcttaaagacttacttctttatgcagcagatcctgctatgcatgttgcatctgctagtgctctgcttgatttacgaacttgttgttttagtgtagctgccattacaagtggtataaagtttcaaactgttaaaccaggtaattttaaccaagatttttatgagtttgtcaaaagtaaaggcttgtttaaagagggtagtacagttgatttgaaacactttttctttactcaagatggtaatgctgcaattactgattataattattataagtataatttacctactatggttgatattaagcagttattgtttgtattagaagttgtttataagtattttgaaatttatgatggtggttgtataccagcatcacaagttattgttaataattatgacaaaagtgctggttatccatttaataaatttggtaaagctagactttattatgaggcattatcatttgaggagcagaatgaaatttatgcatatactaaacgtaatgtgttgcccactttaactcaaatgaatttaaaatatgctattagtgctaagaatagagctcgtactgttgcaggtgtttccattcttagtactatgacaggtcgaatgtttcatcaaaaatgtttgaagagtatagcagctactcgtggtgttcctgttgttataggaactactaaattttatggtggctgggatgatatgttacgccatcttataaaggatgttgacaaccctgttcttatgggttgggattatcctaaatgtgatcgtgccatgccaaatattttgcgtattgttagtagtttagttttggctcgtaaacatgaattttgttgttcacatggtgatagattctatcgccttgcgaatgaatgtgctcaagttttgagtgaaatagttatgtgtggcggttgctattatgttaagcctggtggtactagcagtggtgatgcaaccactgcttttgctaactctgtttttaatatatgtcaagctgttactgctaatgtttgttctcttatggcttgtaatggccataagattgaagatttaagtatacgcaatttacaaaaacgcttatactctaatgtttatcgtacagattatgttgattatacatttgttaatgagtattatgaatttttatgtaagcattttagtatgatgattttgagtgatgatggtgttgtttgttataactctgattatgctagtaagggttatatagccaatataagtgtttttcaacaagttttgtactatcagaataacgtttttatgtctgaatctaaatgttgggttgaaaatgatattactaatggtcctcatgaattctgttcacaacatactatgttggttaagatagatggtgactatgtttatctaccctatccagacccttctagaattttaggagctggttgttttgttgatgatttattgaagactgacagtgttcttttgatagagcgctttgtaagtctagctatagatgcttaccctttagtacaccatgaaaatgaagaataccaaaaagtttttcgtgtatatttagaatatataaaaaaactatataatgatcttggtaatcagatcttagatagttatagtgttattttaagtacttgtgatggtttaaagttcactgatgaatcattttataagaatatgtatttaaaaagtgccgtgatgcagagtgtaggtgcatgtgttgtttgttcatcacagacgtctttgcgttgtggcagttgtatacggaagcctttgttgtgttgtaaatgttgctatgatcatgttatggcaaccaatcataaatatgttttgagtgtttcaccttatgtgtgtaatgcacctaactgtgatgtgagtgatgtcaccaaattatatttgggtggtatgtcttattattgtgaaaaccataaacctcattattcatttaagttagttatgaatggtatggtctttggtttgtataaacaatcttgtacaggttcaccttatatagatgattttaataagatagctagttgtaaatggacagaagttgatgattatgttctggcaaatgagtgtattgaacgtttaaagttatttgctgcagaaactcaaaaggcaactgaagaagcttttaaacaaagctatgcttctgctactattcaagagattgttagtgatagagaaattattttgtgttgggagacaggtaaagttaaaccaccacttaataaaaattatgttttcactggctatcattttactagtactggtaagacagttttaggtgagtatgtttttgataaaagtgaattaactaatggtgtttattatcgcgctacaactacttacaaactttctataggtgatgtttttgtcttaacatcacattctgtagctaatctaagtgcacctacacttgttccacaagagaactatgctagtataagattttctagtgtttatagcgttcctttgctgtttcaaactaatgttgctaactatcagcacattggaatgaaacgttattgcactgtgcaaggtcctcctggtacgggcaagtctcaccttgctataggtttagctgtttattactatacagcacgtgtagtttatactgctgctagtcatgctgctgtagatgcattgtgtgaaaaagcttataagtttttaaatattaatgactgtacacgcattatacctgctaaagttcgtgtagattgttatgataagtttaaaattaatgatactacttgtaagtatgtttttactacaataaatgcattaccagagttagtcacagatattgttgttgttgatgaagttagtatgcttactaattatgaattgtctgttataaatgctcgtgttaaagctaaacattatgtatatattggagatcctgctcagttacctgcaccacgtgtgctattgagtaagggttctttagaacctaggcattttaattctattactaaaataatgtgctgtttaggtcctgatatttttttgggaaattgttatagatgtcctaaagaaattgtagaaactgtttcagcattggtttatgataataaacttaaggctaagaatgataatagttcattatgctttaaagtatattttaagggacagacaacacatgagagttcaagtgctgtaaatattcaacaaatatatttaattagtaaatttttgaaagctaatccagtttggaatagtgctgtttttattagtccttataatagtcagaactatgttgctaagcgtattttaggtgttcaaacacaaactgttgattctgctcaaggttctgaatatgattatgttatatattcacaaacagcagaaacagctcattctattaatgttaatcgatttaatgttgccataactagagccaagaagggtattttctgtgttatgagtaatatgcaattatttgaatctcttaattttattactttacctttagataaaattcagaatcaaactttatctcgtttgcattgtactactaatctttttaaagattgtagtaaaaattttttaggttaccacccagctcatgctccttcatttttatcagttgatgataaatataaggtcaacgaagatttggctgtttgtttaaacatttgtgaacctgttttaacatattctcgtttaatatctctcatggggtttaaattggatttgactcttgatggttattctaaattttttattactaaagacgaagctattaaacgtgttagaggttgggttggttttgatgtagaaggagcccatgctacgcgtgacaacattggaacaaactttccattgcaaataggtttttcaactggtgttgattttgtagttgaagctactggcttatttgctgagagagattgttatatatttaaaagaactgttgctaaagctcctcctggtgataactttaaacatttaataccccttatgtcgaaaggtcaaaagtgggatgttgttagaatcagaattgttcaaatgttgtctgattatcttttggatctttctgatagtgtagtatttattacttggtctgccagttttgaacttacgtgtttaaggtattttgctaaattaggtagagagctcaattgtgatgtgtgtcctaatcgtgcaacatgctataattctagaactggttattacggttgttggcgccatagttatacttgtgattatgtgtataacccgcttattgtagatatacaacagtggggttacacaggttctttaactagtaatcatgatataatttgtaatgtacataaaggtgcacatgttgcatcatctgatgcaattatgactcggtgtttagcaatctatgattgtttttgtaaatctgttaattggaatttagagtatccaataatttccaatgaggttagtataaatacatcttgtaggttattgcagcgtgttatgcttaaagctgccatgctatgtaatagatacaatttatgttatgacattggcaatcctaaaggtattgcttgtgtcaaagattatgaatttaaattctatgatgcttctcctgttgtcaagtctgttaaacagttgttttatgtttatgatgttcataaagataattttaaggatggtttatgtatgttttggaattgtaatgttgataaatatccatctaattcaattgtttgtagatttgatactcgggtattaaataaattaaacctccctggatgtaatggtggtagtttgtatgttaataaacatgcatttcatactaatccttttaccagaacggtctttgaaaatcttaaacctatgccatttttttactattcagatactccttgtgtgtatgtagatggtttggaatccaaacaagttgattatgtgcctttaagaagcgctacttgtatcacacgatgtaatttaggtggtgctgtttgttctaagcatgctgaagattattgtaaatatcttgagtcttataatgtagctactacagcaggctttactttttgggtttataagacttttgatttttataatttatggaatactttcactatgttgcagagcttagaaaatgtaatatataatttggttaatgctggtcattatgatggacgtataggtgaattgccttgtgctattatgaatgacaaagttgttgttaagattaataatgtagatactgttatttttaaaaataatacatcacttcctactaatatagctgttgaattatttacaaaacgtagtattcgccatcaccctgaacttaagattcttagaaatttgaatattgatatttgttggaagcatgtcctttgggattatgttaaagatagtttgttttgtagttctacctatggtgtctgcaaatacacagatttaaattttattgaaaatttgaatgtactttttgatggtcgtgacaatggtgctttagaagcttttagaaaagcaagaaatggtgtttttattagtactggaaaattaagtagtttgtctatgattaaaggtccgcaacgagctgatttaaatggcgtaattgtggataaagttggagaactcaatgttgagttttggtttgctatgagaaaagatggtgacgatgttatcttcagccgtgcagacagcctaagcccaagccattactggagcccacaaggtaatctaggtggtaattgtgcaggtaatgccagcggtaatgatgctctagcgcgttttactatctttactcagagtcgtgtattgtcaacctttgaacctcgctcagatttagaacgggattttattgatatggaggatagtctgtttatagccaaatatggtttagaagattatgcatttgatcatatagtttatggtagttttaattataaagttataggaggtttgcacttgcttataggtttatttcgtagactaaaaaaatctaatttggtaattcaagagtttttgcagtatgattctagtattcattcatatttcattactgatcaagagtgtggtagtagtaagagtgtttgtacagttattgatttattattagatgactttgttgttattgttaagtcattaaatttgaattgtgttagtaaagttgttaatattaatgttgactttaaggactttcaatttatgttgtggtgtaatgataataaaattatgactttttatcctaaaatgcaagctactagtgactggaaacctggttattctatgcctgttttatataagtatttgaatgttccattagagagagtttctttatggaattatggtaaagctattaatttaccaacaggttgtatgatgaatgttgctaagtatactcaattatgtcagtatttaaatactacaacattagctgttcctgttaatatgcgtgtcttacacttaggtgcaggatctgataaagaagtagcccctggttctgctgttttaagacagtggttaccatctggtagtattcttgtagataatgatttaaatccttttgttagtgatagtttagtcacttattttggagattgtatgactttaccatttgattgtcattgggatctgataatatctgatatgtatgatcctcttactaagaatattggtgattataatgtgagtaaggatggtttctttacttatatttgttatttaattcgtgataaattatctttgggtggtagtgttgctataaaaattacagaattttcttggaatgctgacttatataaattaatgagttattttgcattctggacagttttttgtactaatgtaaatgcttcttctagtgaagggtttttaataggtataaattatttgggtaagtcctgctttgaaatagatggcaatgttatgcatgccaactatttgttttggagaaatagtacaacatggaatggtggtgcttatagtttatttgatatgtctaaattttctttgaaattggctggcactgctgtagtaaatttaagaccagatcaattaaatgatttagtttattctcttattgaaagaggtaagttattagtgcgtgatacgcgtaaagaaatttttgttggtgatagtcttgtaaacacttgttagatctttcagtttgttaatattaaatctaaactatgttaattatatttttattttttaatttttgttatggttttaatgaacctttgaatgttgtgtctcatttaaaccatgactggtttttatttggtgatagtcgttctgattgtaaccatattaataatttaaaaattaaaaattatggttatttggatattcaccctagtttgtgtaataatggtaaaatttcatctagtgctggtgattctatttttaagagttatcattttacccggttttataattacactggcgagggtgatcaaattattttttatgagggtgttaatttcaatcctcatcataggtttaagtgcttctttaatggtagtaatgatgtatggatttttaacaaggtgaggttttatcgtgctttatattctaatatggctctttttcgctatcttacctttgttgatattctttacaatttttctttttctattaaggctaatatttgtaatagtaatattttatcacttaataatcctatttttattagtactaattattctaaggacgtttatttcactttatcagggtgttctttgtatttagtacctctttgtctttttaaatctaattttagtcagtactattataatatggatactggctttgcttatggttattctaattttgtttcttctgatttagattgtacatatatttctcttaaacctggttcttataaaattttttctactggttttgttttatccatacctactaaagctctttgctttaataaatctaaacaatttgtacccgtgcaggttgttgattctaggtggaacaatcttcgtgcatcggatacttcattatccgatgcatgtcagttgccttattgttattttcgcaattcttctggtaattatgttggcaaatatgatattaatcatggtgataatggttttacttctattctatctggtcttttatataatgtctcttgtatttcttattatggctcctttttgtatgacaattttacatcaatttggcctcgtttttcttttggtaattgtcctacatctgcttatattaaattaaattgtttctatgatcctttgcctattattttacaaggtattttattatttttagctttattgtttattgtgtttttactttttctagtttaccatggctaatattaaatctaaacatgtttttaattatttttattttgcctacaacactagctgttataggtgattttaattgtactaactcttttattaatgattataataaaaccattccgcgtataagcgaggatgttgttgatgtatctcttggtttgggcacatattatgttcttaaccgtgtttatttaaatactaccttgttatttacaggttattttcctaaatctggtgctaattttagagacttggctttaaagggttctaaatatttgagtactctctggtataaaccaccttttctgtcagattttaataatggtattttttctaaggttaagaatactaagttatatgttaataatactttgtatagtgaatttagtactatagttataggtagtgtttttgttaatacttcttatactattgttgttcaacctcacaatggtattttggagattacagcttgtcagtatactatgtgtgaatatcctcacactgtttgtaagtctaagggtagtattcgtaatgaatcttggcacattgattcttcggaacctttatgcttgtttaagaaaaattttacttataatgtttctgcagattggctgtattttcatttttatcaagaacgtggtgttttttatgcatattatgcagatgtaggtatgcctaccactttcttatttagtttatatttaggtactattttatctcattattatgttatgcctttgacttgtaaggctatatcttcaaatactgacaatgaaactttagaatattgggttacaccgctatctagacgtcagtatcttcttaattttgatgagcacggtgttattactaatgccgttgattgttcaagtagttttcttagtgagattcaatgtaaaactcaatcttttgcacctaatactggtgtttatgatttgtctggttttactgtaaagcctgttgcaactgtttatcgtcggattcctaatttacctgattgtgacattgacaactggcttaataatgttagtgtaccttcacctcttaattgggaacgtagaattttttctaattgtaacttcaatttaagcactttacttcgtctagttcatgttgattctttttcttgtaataatcttgataaatctaaaatttttggtagttgctttaatagtattactgttgacaagtttgctatacctaatcgcagacgagatgatttgcaattgggcagttctggctttttgcaatcatctaattacaaaatagatatttcttctagttcttgtcaattgtattatagtttacctttagttaatgttactattaataactttaatccatcttcttggaataggaggtatggttttggtagttttaatgtgtcttcttatgacgttgtttattctgatcattgtttttctgttaacagcgacttttgcccttgtgcagatccgtctgttgttaattcttgtgttaaatctaagcctctttctgccatttgtcctgctggtactaaatatcgtcattgcgacttggatactactctttatgttaataactggtgtagatgttcttgtctacctgaccccatttctacttattctcctaacacatgtcctcaaaagaaggtcgttgttggtataggtgaacattgtccaggtcttggtattaatgaggaaaaatgtggtacacaattaaatcatagttcctgttcttgtagtcctgatgcctttttgggttggtcttttgatagttgtattagtaataatcgttgcaatattttttctaattttatttttaatggaattaatagtggcaccacttgttctaatgatttgttatattctaacactgaagtttctactggtgtttgtgttaattatgatctttatggcatcacaggccaaggtatttttaaagaagtttctgcggcttattataataattggcagaatcttttgtatgattctaatggtaatattattggttttaaagattttttgactaataaaacttacactatacttccttgttattctggtagagtgtctgctgcattttatcaaaattcttcttcaccagctttgctttatcgtaatttaaagtgtagttatgttttgaataatatttcttttatctcacaaccattttattttgatagttatcttggttgtgttttgaatgctgttaatttaactagctattctgtatcctcttgtgatttgcgtatgggtagtgggttttgtattgattatgctttaccctcttctcggcgtaagcgtagaggtatttcttctccttatcgctttgtaacttttgaaccctttaatgttagttttgttaacgatagtgttgaaactgttggtggtttatttgagattcagattcctactaactttaccatagctggtcatgaagaatttattcagactagttctcctaaagttactattgattgttcagcttttgtttgctctaattatgctgcttgtcatgatttattgtcggaatatggcactttttgcgataatattaatagtattttaaatgaagtcaatgatttacttgatattactcagttgcaggttgctaatgctttaatgcaaggtgttacacttagttctaatcttaatactaatctacactctgatgttgataatatagattttaaatctcttctaggttgtttaggttcacaatgtggttcttcgtctagatctttgttagaggatttattattcaacaaggtcaaactttcagatgtaggttttgttgaagcttataataattgcactggtggtagtgaaattagagatcttctctgtgtgcaatcttttaatggtattaaagtattacctcccattttatctgagactcaaatttctggctatactacagctgctactgtggcggctatgtttccgccatggtctgctgctgctggtgtaccattttctcttaatgtacaatatagaattaatggtttgggtgttactatggatgttcttaataagaatcaaaagttaatagctaatgcttttaataaagctcttctttctatccagaatggttttactgctactaactctgctcttgctaaaattcaaagtgtcgttaatgctaatgctcaagcacttaatagtttgttacaacaattatttaataaatttggtgctattagttcttctttacaagaaattttgtctcgccttgataatttagaagctcaggttcagattgataggctcattaatggtcgtttgactgctttaaatgcttatgtttctcaacagcttagtgatattacacttattaaggctggagcttctcgtgctattgagaaggttaatgagtgtgttaaaagtcaatcccctcgtataaatttttgtggcaatggtaaccacattttatcattggttcaaaatgctccttatggtttgcttttcattcattttagttataaacctacttcttttaaaactgtcttagtaagtccaggtttatgtttatccggtgatagaggtattgcacctaagcaaggttattttattaaacaaaatgattcctggatgtttactggtagttcctattattacccagaaccaatttcagataaaaatgttgttttcatgaatagttgctctgttaattttactaaagctccatttatttatcttaataattctataccaaatttgtctgattttgaagccgagttttctctttggtttaaaaatcatacttctatagcacctaatttaacctttaattctcatattaatgctacttttttagatctgtattatgaaatgaatgttattcaggaatctattaaatctttgaacagtagttttattaatcttaaagaaataggtacttatgaaatgtatgttaaatggccttggtacatttggttgttaattgtcattttatttataatttttcttatgatacttttctttatatgctgctgtactggttgtggttcagcatgttttagtaaatgtcataattgttgtgatgagtatgggggtcacaatgattttgttattaaagcatctcatgatgattagattttaaatctaaactttatatatggaagtttggaggcctagctataaatattctcttattactagagaatttggtgtcacagatcttgaggatttgtgttttaaatataattattgccaaccttgtgttggttattgtattgtacctttaaacgtttggtgtcgtaagtttggtaaatttgcttcttattttgttttacgtagtcatgacacctctcataagaataattttggtgttataactagttttactagttatggtaacactgtttctgaggctgtttctaaattagttgaatcagcatctgattttatcgcttggcgagctgaagcacttaataagtatggttgatgtatttttcactgatactgcttggtatgtaggtcagattttctttttagttttatcttgtgtcattttcttaatttttgttgttgcacttttagcaactattaaactttgtattcaaatttgtggtttttgtaatatttttattatttcaccttctgcctatgtttataatagaggtagacagttgtataagtcttatagtgaacatgtcataccttctactttagatgatttaatttaaatctaaacatcatgaatgaatcaatttttcctcattggaattctgatcaagctattacattcttaaaagaatggaatttctctttgggtgtaatattacttctcattactatcatactgcagtttggttatacgagtcgtagtatgtttgtttatcttattaagatgattattctttggcttatgtggccattgaccattatcttgactatatttaattgcttttatgctttgaataatatctttcttgggctttctatactgtttactattatttctattgttatatggattttatattttgtcaacagtattcggctttttatcagaactggcagttggtggagttttaacccagagactaataatcttatgtgtattgatatgaaaggtaagatgtatgttaggccagttattgaggactatcatacattaacggctactgttatccgtggtcatctttatatacagggtgttaaacttggcactggttacacgcttgccgatttgcctgtttatgttactgtagctaaggtgcaagtcctctgtacttataaacgtgcctttttagataagttagatgttaatagtggttttgctgtttttgttaagtctaaagttggtaactatcgtttaccttctagtaaatctagtggtatggatactgccttgttgagagcttaaatctaaactattaggatgtcttatactcccggtcatcatgctggaagtagaagctcctctggaaatcgttcaggaatcctcaagaaaacttcttgggttgaccaatctgagcgaagccatcaaacctataatagaggcagaaaaccccaacccaaattcactgtgtctactcaaccacaaggaaaccctatcccacattattcctggttctctgggattacccaatttcaaaaaggtagagactttaaatttccagatggtcaaggagtacccattgcttacgggatacccccttctgaagcaaaaggatattggtataaacacaaccggcgttcttttaaaacagctgatggtcaacaaaagcagttgttaccaagatggtatttctactatctcggtaccggtccatatgccagttcatcctatggtgatgcccacgaaggtatcttctgggtcgctagtcaccaagctgacacttctattccctccgatgtttcggcaagggatcctactattcaagaagctatccctactaggttttcgcctggtacgattttgcctcaaggctattatgttgaaggctcaggaaggtctgcttctaatagccggccaggttcacgttctcaatcacgtggacccaataatcgttcattaagtagaagtaattctaattttagacattctgattctatagtgaaacctgatatggctgatgagattgctagtcttgtcttggccaagcttggtaaagattctaaacctcagcaagttaccaagcaaaatgctaaggaaattaggcataaaattttaatgaaacctcgccaaaagcgaactcctaataaattttgtaatgttcaacagtgttttggtaaaagaggaccgctccaaaactttggtaattctgaaatgttaaagcttggtactaatgatcctcaatttcctattcttgctgaattagcccctacaccaggtgcttttttctttggctctaaattagagttgtttaaaagagactctgatgctgattcaccttctaaagacacttttgaacttcgttattctggttctattaggtttgatagtactttacctggttttgagacaattatgaaagttcttaaagagaatttagatgcttatgttaattctaatcagaacactgtttctggttcgctgagtcctaaacctcagcgtaaaagaggtgttaaacaatcacctgaatcgtttgactctcttaatttaagtgctgatactcagcacatttcaaatgattttactcctgaggatcatagtttacttgctactcttgatgatncttatgtagaagactctgttgcttaatgagaatgaatcctaattcgacactaggtggtaacccctcgctattagtcggaataggacactctctatcagaatgaattcttgctgttacaacagatagagtaggttgttgcagactatatattaattagtagaaactttatatttaaatatttgattgttagagtagttataaggtttagctgtagtataaacgcctccgggaagagctagcaattatagtatttaatatatatattagtatatgattgaaattaattatagccttttggaggaattacaaaaaaaaaaaaaaa

SEQ ID NO: 2920 - DNA, 2784 bp, Corononavirus-HKU1
  CDS (1)..(2784)
tctaaagatttaaattttttaaaccgggttcggggtactagtgtgaatgcccgtctagtaccctgtgctagtggtttatctactgatgttcaattaagggcatttgatatttgtaatactaatagagctggtataggtttatattataaagtgaattgttgccgttttcagcgtatagatgacgacggtaataaattggataagttctttgttgttaaaagaactaatctagaagtttataataaagagaaaacttattatgagttgactaaaagttgtggtgttgtggctgaacatgatttctttacatttgatattgatggtagtcgtgtgccacatatagttcgtaagaacctctcaaagtatactatgttagatctttgctatgcattgcgccattttgattgtaatgattgttcagtattgtgtgaaattctttgtgagtatgctgattgtaaagaatcctacttttctaagaaagattggtatgattttgttgaaaatcctgatattattaatatttataaaaaattaggccctatttttaatagagctttacttaatactgtcagttttgcagatactttagtaaaagtaggtttagttggtgttttaactttagataatcaagacttgtatggtcaatggtatgattttggtgattttatacaaacagctccaggttttggtgtggcagttgcagattcttactattcttatatgatgcctatgttgactatgtgtcatgtattagattgtgaattatttgttaatgatagttatagacaattcgatcttgtacagtatgattttactgattataagttagaattgtttaataagtattttaagtattggggtatgaagtatcatcctaatactgtggattgtgataatgataggtgtattattcattgtgctaattttaatatattatttagtatggtcttacctaatacttgttttggtcctcttgttagacaaatttttgtagatggtgttccgtttgttgtttcaattggttaccattataaagagttaggtgtagttatgaacttggatgttgatacacaccgctatcgtttgtctcttaaagacttacttctttatgcagcagatcctgctatgcatgttgcatctgctagtgctctgcttgatttacgaacttgttgttttagtgtagctgccattacaagtggtataaagtttcaaactgttaaaccaggtaattttaaccaagatttttatgagtttgtcaaaagtaaaggcttgtttaaagagggtagtacagttgatttgaaacactttttctttactcaagatggtaatgctgcaattactgattataattattataagtataatttacctactatggttgatattaagcagttattgtttgtattagaagttgtttataagtattttgaaatttatgatggtggttgtataccagcatcacaagttattgttaataattatgacaaaagtgctggttatccatttaataaatttggtaaagctagactttattatgaggcattatcatttgaggagcagaatgaaatttatgcatatactaaacgtaatgtgttgcccactttaactcaaatgaatttaaaatatgctattagtgctaagaatagagctcgtactgttgcaggtgtttccattcttagtactatgacaggtcgaatgtttcatcaaaaatgtttgaagagtatagcagctactcgtggtgttcctgttgttataggaactactaaattttatggtggctgggatgatatgttacgccatcttataaaggatgttgacaaccctgttcttatgggttgggattatcctaaatgtgatcgtgccatgccaaatattttgcgtattgttagtagtttagttttggctcgtaaacatgaattttgttgttcacatggtgatagattctatcgccttgcgaatgaatgtgctcaagttttgagtgaaatagttatgtgtggcggttgctattatgttaagcctggtggtactagcagtggtgatgcaaccactgcttttgctaactctgtttttaatatatgtcaagctgttactgctaatgtttgttctcttatggcttgtaatggccataagattgaagatttaagtatacgcaatttacaaaaacgcttatactctaatgtttatcgtacagattatgttgattatacatttgttaatgagtattatgaatttttatgtaagcattttagtatgatgattttgagtgatgatggtgttgtttgttataactctgattatgctagtaagggttatatagccaatataagtgtttttcaacaagttttgtactatcagaataacgtttttatgtctgaatctaaatgttgggttgaaaatgatattactaatggtcctcatgaattctgttcacaacatactatgttggttaagatagatggtgactatgtttatctaccctatccagacccttctagaattttaggagctggttgttttgttgatgatttattgaagactgacagtgttcttttgatagagcgctttgtaagtctagctatagatgcttaccctttagtacaccatgaaaatgaagaataccaaaaagtttttcgtgtatatttagaatatataaaaaaactatataatgatcttggtaatcagatcttagatagttatagtgttattttaagtacttgtgatggtttaaagttcactgatgaatcattttataagaatatgtatttaaaaagtgccgtgatgcag

SEQ ID NO: 2921 - protein, 928 aa, Corononavirus-HKU1
SKDLNFLNRVRGTSVNARLVPCASGLSTDVQLRAFDICNTNRAGIGLYYKVNCCRFQRIDDDGNKLDKFFVVKRTNLEVYNKEKTYYELTKSCGVVAEHDFFTFDIDGSRVPHIVRKNLSKYTMLDLCYALRHFDCNDCSVLCEILCEYADCKESYFSKKDWYDFVENPDIINIYKKLGPIFNRALLNTVSFADTLVKVGLVGVLTLDNQDLYGQWYDFGDFIQTAPGFGVAVADSYYSYMMPMLTMCHVLDCELFVNDSYRQFDLVQYDFTDYKLELFNKYFKYWGMKYHPNTVDCDNDRCIIHCANFNILFSMVLPNTCFGPLVRQIFVDGVPFVVSIGYHYKELGVVMNLDVDTHRYRLSLKDLLLYAADPAMHVASASALLDLRTCCFSVAAITSGIKFQTVKPGNFNQDFYEFVKSKGLFKEGSTVDLKHFFFTQDGNAAITDYNYYKYNLPTMVDIKQLLFVLEVVYKYFEIYDGGCIPASQVIVNNYDKSAGYPFNKFGKARLYYEALSFEEQNEIYAYTKRNVLPTLTQMNLKYAISAKNRARTVAGVSILSTMTGRMFHQKCLKSIAATRGVPVVIGTTKFYGGWDDMLRHLIKDVDNPVLMGWDYPKCDRAMPNILRIVSSLVLARKHEFCCSHGDRFYRLANECAQVLSEIVMCGGCYYVKPGGTSSGDATTAFANSVFNICQAVTANVCSLMACNGHKIEDLSIRNLQKRLYSNVYRTDYVDYTFVNEYYEFLCKHFSMMILSDDGVVCYNSDYASKGYIANISVFQQVLYYQNNVFMSESKCWVENDITNGPHEFCSQHTMLVKIDGDYVYLPYPDPSRILGAGCFVDDLLKTDSVLLIERFVSLAIDAYPLVHHENEEYQKVFRVYLEYIKKLYNDLGNQILDSYSVILSTCDGLKFTDESFYKNMYLKSAVMQ

SEQ ID NO: 2922 - DNA, 2784 bp, Corononavirus-HKU1
  CDS (1)..(2784)
tctaaagatttaaattttttaaaccgggttcggggtactagtgtgaatgcccggctagtaccctgtgctagtggtttatctactgatgttcaattaagggcatttgacatttgtaataccaatagagctggtataggtttatattataaagtgaattgttgccgttttcagcgtatagatgacgacggtaataaattggataagttctttgttgtcaaaagaactaatttagaagtttataataaagagaaaacttattatgagttgactaaaagttgtggtgttgtggctgaacatgatttctttacatttgatattgatggtagtcgcgtgccacatatagttcgtaggaatctttcaaagtatactatgttagatctttgctatgcattgcgtcattttgatcgtaatgattgttcaatattgtgtgaaattctttgtgagtatgctgattgtaaagaatcctacttttctaagaaagattggtatgattttgttgaaaatcctgatattattaatatatataaaaaattaggccctatttttaatagagctttacttaatactgtcatttttgcagacaccttagttgaagtaggtttagttggtgttttaactttagataaccaagatttgtatggtcaatggtatgattttggtgattttatacaaacagccccagggtttggtgtggcagttgcagattcttacttttcttatatgatgcctatgttgactatgtgtcatgtattagattgtgaattatttgttaatgatagttatagacaattcgatcttgtacagtatgattttactgattacaagttagagttgtttaataagtattttaagtattggggtatgaagtatcatcctaatactgtggattgtgataatgataggtgtattattcattgtgctaattttaatatactatttagtatggttttacctaatacttgttttggtccccttgttagacaaatttttgtagatggtgtaccgtttgttgtttctattggttaccattacaaagagttaggtgtagttatgaacttagatgttgacacacaccgttatcgtttgtctcttaaagatttacttctttatgcagcagatcctgctatgcacgttgcatctgctagtgctctgcttgatttacgaacttgttgttttagtgtagctgccattacaagtggtataaaatttcaaactgtaaaaccaggtaactttaaccaagacttttacgagtttgttaaaagtaaaggcttgtttaaagagggtagtacagttgatttgaaacattttttctttactcaagatggtaatgctgcaattactgattataattattataagtataatttacctactatggttgatattaagcagttattgtttgtattagaagttgtttataaatattttgaaatttatgatggtggttgtataccagcatcacaagttattgttaataattatgataaaagtgctggttatccatttaataaatttggtaaagccagactttattatgaggcattatcatttgaggaacagaatgaaatttatgcatatactaaacgtaatgttctgcccaccttaactcaaatgaatttaaaatatgctatcagtgctaagaatagagctcgcactgtagcaggtgtttctattcttagtactatgacaggccgaatgttccatcaaaaatgtttgaagagtatagcagctacccgaggtgttcctgttgttataggaaccactaaattttatggtggttgggacgatatgttacgtcatcttataaaggatgttgacaaccctgttcttatgggttgggattatcctaaatgtgatcgtgctatgccaaatattttgcgtattgttagtagtttagttttggcccgcaaacatgaattttgttgttcacatggtgatagattttatcgccttgcgaatgaatgtgctcaagttttgagtgaaatagttatgtgtggcggttgctattatgttaagcctggtggtactagcagtggtgatgcaactactgcttttgctaattctgtttttaatatatgtcaggctgttactgctaatgtttgttctcttatggcctgtaatggccataagattgaagatttaagtatacgcaatttacaaaaacgcttatactctaatgtttatcgtacagattatgttgattatacatttgttaatgagtattatgaatttttatgtaagcattttagtatgatgattttgagtgatgatggtgttgtctgttataactctgattatgctagtaagggttatatagctaatataagtgtttttcaacaagttttgtactatcagaataatgtctttatgtctgaatctaaatgttgggttgaaaatgatattactaatggtcctcatgaattttgttcccaacatactatgttagttaagatagatggtgattatgtttatttaccatatccagatccttctagaattttaggagctggttgttttgttgatgatttattgaagactgacagtattcttttgatagagcgctttgtaagtctagctatagatgcttaccctttagtacatcatgaaaatgaagaataccaaaaagtctttcgtgtatatttagaatatataaaaaaactgtataatgatcttggtactcagatcttagatagttatagtgttattttaagtacttgtgatggtttaaagtttactgaagaatcattttacaagaatatgtatttaaaaagtgccgtgatgcag

SEQ ID NO: 2923 - protein, 928 aa, Corononavirus-HKU1
SKDLNFLNRVRGTSVNARLVPCASGLSTDVQLRAFDICNTNRAGIGLYYKVNCCRFQRIDDDGNKLDKFFVVKRTNLEVYNKEKTYYELTKSCGVVAEHDFFTFDIDGSRVPHIVRRNLSKYTMLDLCYALRHFDRNDCSILCEILCEYADCKESYFSKKDWYDFVENPDIINIYKKLGPIFNRALLNTVIFADTLVEVGLVGVLTLDNQDLYGQWYDFGDFIQTAPGFGVAVADSYFSYMMPMLTMCHVLDCELFVNDSYRQFDLVQYDFTDYKLELFNKYFKYWGMKYHPNTVDCDNDRCIIHCANFNILFSMVLPNTCFGPLVRQIFVDGVPFVVSIGYHYKELGVVMNLDVDTHRYRLSLKDLLLYAADPAMHVASASALLDLRTCCFSVAAITSGIKFQTVKPGNFNQDFYEFVKSKGLFKEGSTVDLKHFFFTQDGNAAITDYNYYKYNLPTMVDIKQLLFVLEVVYKYFEIYDGGCIPASQVIVNNYDKSAGYPFNKFGKARLYYEALSFEEQNEIYAYTKRNVLPTLTQMNLKYAISAKNRARTVAGVSILSTMTGRMFHQKCLKSIAATRGVPVVIGTTKFYGGWDDMLRHLIKDVDNPVLMGWDYPKCDRAMPNILRIVSSLVLARKHEFCCSHGDRFYRLANECAQVLSEIVMCGGCYYVKPGGTSSGDATTAFANSVFNICQAVTANVCSLMACNGHKIEDLSIRNLQKRLYSNVYRTDYVDYTFVNEYYEFLCKHFSMMILSDDGVVCYNSDYASKGYIANISVFQQVLYYQNNVFMSESKCWVENDITNGPHEFCSQHTMLVKIDGDYVYLPYPDPSRILGAGCFVDDLLKTDSILLIERFVSLAIDAYPLVHHENEEYQKVFRVYLEYIKKLYNDLGTQILDSYSVILSTCDGLKFTEESFYKNMYLKSAVMQ

SEQ ID NO: 2924 - DNA, 2784 bp, Corononavirus-HKU1
  CDS (1)..(2784)
tctaaagatttaaattttttaaaccgggttcggggtactagtgtgaatgcccggctagtaccctgtgctagtggtttatctactgatgttcaattaagggcatttgacatttgtaataccaatagagctggtataggtttatattataaagtgaattgttgccgttttcagcgtatagatgacgacggtaataaattggataagttctttgttgtcaaaagaactaatttagaagtttataataaagagaaaacttattatgagttgactaaaagttgtggtgttgtggctgaacatgatttctttacatttgatattgatggtagtcgcgtgccacatatagttcgtaggaatctttcaaagtatactatgttagatctttgctatgcattgcgtcattttgatcgtaatgattgttcaatattgtgtgaaattctttgtgagtatgctgattgtaaagaatcctacttttctaagaaagattggtatgattttgttgaaaatcctgatattattaatatatataaaaaattaggccctatttttaatagagctttacttaatactgtcatttttgcagacaccttagttgaagtaggtttagttggtgttttaactttagataaccaagatttgtatggtcaatggtatgattttggtgattttatacaaacagccccaggatttggtgtggcagtcgcagattcttactattcttatatgatgcctatgttgactatgtgtcatgtattagattgtgaattatttgttaatgatagttatagacaattcgatcttgtgcagtatgattttactgattacaagttagagttgtttaataagtattttaagtattggggtatgaagtatcatcctaatactgtggattgtgataatgataggtgtattattcattgtgctaattttaatatactatttagtatggttttacctaatacttgttttggtccccttgttagacaaatttttgtagatggtgtaccgtttgttgtttctattggttaccattacaaagagttaggtgtagttatgaacttagatgttgacacacaccgttatcgtttgtctcttaaagatttacttctttatgcagcagatcctgctatgcatgttgcatctgctagtgctctgcttgatttacgaacttgttgttttagtgtagctgccattacaagtggtataaaatttcaaactgtaaaaccaggtaactttaaccaagacttttacgagtttgttaaaagtaaaggcttgtttaaagagggtagtacagttgatttgaaacattttttctttactcaagatggtaatgctgcaattactgattataattattataagtataatttacctactatggttgatattaagcagttattgtttgtattagaagttgtttataaatattttgaaatttatgatggtggttgtataccagcatcacaagttattgttaataattatgataaaagtgctggttatccatttaataaatttggtaaagccagactttattatgaggcattatcatttgaagaacagaatgaaatttatgcatatactaaacgtaatgttctgcccaccttaactcaaatgaatttaaaatatgctatcagtgctaagaatagagctcgcactgtagcaggtgtttctattcttagtactatgacaggccgaatgttccatcaaaaatgtttgaagagtatagcagctacccgaggtgttcctgttgttataggaaccactaaattttatggtggttgggacgatatgttacgtcatcttataaaggatgttgacaaccctgttcttatgggttgggattatcctaaatgtgatcgtgctatgccaaatattttgcgtattgttagtagtttagttttggcccgcaaacatgaattttgttgttcacatggtgatagattttatcgccttgcgaatgaatgtgctcaagttttgagtgaaatagttatgtgtggcggttgctattatgttaagcctggtggtactagcagtggtgatgcaactactgcttttgctaattctgtttttaatatatgtcaggctgttactgctaacgtttgttctcttatggcctgtaatggccataagattgaagatttaagtatacgcaatttacaaaaacgcttatactctaatgtttatcgtacagattatgttgattatacatttgttaatgagtattatgaatttttatgtaagcattttagtatgatgattttgagtgatgatggtgttgtctgttataactctgattatgctagtaagggttatatagctaatataagtgtttttcaacaagttttgtactatcagaataatgtttttatgtctgaatctaaatgttgggttgaaaatgatattactaatggtcctcatgaattttgttcccaacatactatgttggttaagatagatggtgattatgtttatttaccatatccagatccttctagaattctaggagctggttgttttgttgatgatttattgaagactgacagtgttcttttgatagagcgctttgtaagtctagctatagatgcttaccctttagtatatcatgaaaatgaagaataccaaaaagtctttcgtgtatatttagaatatataaaaaaactgtataatgatcttggtactcagatcttagatagttatagtgttattttaagtacttgtgatggtttaaagtttactgaagaatcattttacaagaatatgtatttaaaaagtgccgtgatgcag

SEQ ID NO: 2925 - protein, 928 aa, Corononavirus-HKU1
SKDLNFLNRVRGTSVNARLVPCASGLSTDVQLRAFDICNTNRAGIGLYYKVNCCRFQRIDDDGNKLDKFFVVKRTNLEVYNKEKTYYELTKSCGVVAEHDFFTFDIDGSRVPHIVRRNLSKYTMLDLCYALRHFDRNDCSILCEILCEYADCKESYFSKKDWYDFVENPDIINIYKKLGPIFNRALLNTVIFADTLVEVGLVGVLTLDNQDLYGQWYDFGDFIQTAPGFGVAVADSYYSYMMPMLTMCHVLDCELFVNDSYRQFDLVQYDFTDYKLELFNKYFKYWGMKYHPNTVDCDNDRCIIHCANFNILFSMVLPNTCFGPLVRQIFVDGVPFVVSIGYHYKELGVVMNLDVDTHRYRLSLKDLLLYAADPAMHVASASALLDLRTCCFSVAAITSGIKFQTVKPGNFNQDFYEFVKSKGLFKEGSTVDLKHFFFTQDGNAAITDYNYYKYNLPTMVDIKQLLFVLEVVYKYFEIYDGGCIPASQVIVNNYDKSAGYPFNKFGKARLYYEALSFEEQNEIYAYTKRNVLPTLTQMNLKYAISAKNRARTVAGVSILSTMTGRMFHQKCLKSIAATRGVPVVIGTTKFYGGWDDMLRHLIKDVDNPVLMGWDYPKCDRAMPNILRIVSSLVLARKHEFCCSHGDRFYRLANECAQVLSEIVMCGGCYYVKPGGTSSGDATTAFANSVFNICQAVTANVCSLMACNGHKIEDLSIRNLQKRLYSNVYRTDYVDYTFVNEYYEFLCKHFSMMILSDDGVVCYNSDYASKGYIANISVFQQVLYYQNNVFMSESKCWVENDITNGPHEFCSQHTMLVKIDGDYVYLPYPDPSRILGAGCFVDDLLKTDSVLLIERFVSLAIDAYPLVYHENEEYQKVFRVYLEYIKKLYNDLGTQILDSYSVILSTCDGLKFTEESFYKNMYLKSAVMQ

SEQ ID NO: 2926 - DNA, 2784 bp, Corononavirus-HKU1; identical to SEQ ID NO: 2924
  CDS (1)..(2784)

SEQ ID NO: 2927 - protein, 928 aa, Corononavirus-HKU1; identical to SEQ ID NO: 2925

SEQ ID NO: 2928 - DNA, 2784 bp, Corononavirus-HKU1
  CDS (1)..(2784)
tctaaagatttaaattttttaaaccgggttcggggtactagtgtgaatgcccggctagtaccctgtgctagtggtttatctactgatgttcaattaagggcatttgacatttgtaataccaatagagctggtataggtttatattataaagtgaattgttgccgttttcagcgtatagatgacgacggtaataaattggataagttctttgttgtcaaaagaactaatttagaagtttataataaagagaaaacttattatgagttgactaaaagttgtggtgttgtggctgaacatgatttctttatatttgatattgatggtagtcgcgtgccacatatagttcgtaggaatctttcaaagtatactatgttagatctttgctatgcattgcgtcattttgatcgtaatgattgttcaatattgtgtgaaattctttgtgagtatgctgattgtaaagaatcctacttttctaagaaagattggtatgattttgttgaaaatcctgatattattaatatatataaaaaattaggccctatttttaatagagctttacttaatactgtcatttttgcagacaccttagttgaagtaggtttagttggtgttttaactttagataaccaagatttgtatggtcaatggtatgattttggtgattttatacaaacagccccaggatttggtgtggcagtcgcagattcttactattcttatatgatgcctatgttgactatgtgtcatgtattagattgtgaattatttgttaatgatagttatagacaattcgatcttgtgcagtatgattttactgattacaagttagagttgtttaataagtattttaagtattggggtatgaagtatcatcctaatactgtggattgtgataatgataggtgtattattcattgtgctaattttaatatactatttagtatggttttacctaatacttgttttggtccccttgttagacaaatttttgtagatggtgtaccgtttgttgtttctattggttaccattacaaagagttaggtgtagttatgaacttagatgttgacacacaccgttatcgtttgtctcttaaagatttacttctttatgcagcagatcctgctatgcatgttgcatctgctagtgctctgcttgatttacgaacttgttgttttagtgtagctgccattacaagtggtataaaatttcaaactgtaaaaccaggtaactttaaccaagacttttacgagtttgttaaaagtaaaggcttgtttaaagagggtagtacagttgatttgaaacattttttctttactcaagatggtaatgctgcaattactgattataattattataagtataatttacctactatggttgatattaagcagttattgtttgtattagaagttgtttataaatattttgaaatttatgatggtggttgtataccagcatcacaagttattgttaataattatgataaaagtgctggttatccatttaataaatttggtaaagccagactttattatgaggcattatcatttgaagaacagaatgaaatttatgcatatactaaacgtaatgttctgcccaccttaactcaaatgaatttaaaatatgctatcagtgctaagaatagagctcgcactgtagcaggtgtttctattcttagtactatgacaggccgaatgttccatcaaaaatgtttgaagagtatagcagctacccgaggtgttcctgttgttataggaaccactaaattttatggtggttgggacgatatgttacgtcatcttataaaggatgttgacaaccctgttcttatgggttgggattatcctaaatgtgatcgtgctatgccaaatattttgcgtattgttagtagtttagttttggcccgcaaacatgaattttgttgttcacatggtgatagattttatcgccttgcgaatgaatgtgctcaagttttgagtgaaatagttatgtgtggcggttgctattatgttaagcctggtggtactagcagtggtgatgcaactactgcttttgctaattctgtttttaatatatgtcaggctgttactgctaacgtttgttctcttatggcctgtaatggccataagattgaagatttaagtatacgcaatttacaaaaacgcttatactctaatgtttatcgtacagattatgttgattatacatttgttaatgagtattatgaatttttatgtaagcattttagtatgatgattttgagtgatgatggtgttgtctgttataactctgattatgctagtaagggttatatagctaatataagtgtttttcaacaagttttgtactatcagaataatgtttttatgtctgaatctaaatgttgggttgaaaatgatattactaatggtcctcatgaattttgttcccaacatactatgttggttaagatagatggtgattatgtttatttaccatatccagatccttctagaattctaggagctggttgttttgttgatgatttattgaagactgacagtgttcttttgatagagcgctttgtaagtctagctatagatgcttaccctttagtatatcatgaaaatgaagaataccaaaaagtctttcgtgtatatttagaatatataaaaaaactgtataatgatcttggtactcagatcttagatagttatagtgttattttaagtacttgtgatggtttaaagtttactgaagaatcattttacaagaatatgtatttaaaaagtgccgtgatgcag

SEQ ID NO: 2929 - protein, 928 aa, Corononavirus-HKU1
SKDLNFLNRVRGTSVNARLVPCASGLSTDVQLRAFDICNTNRAGIGLYYKVNCCRFQRIDDDGNKLDKFFVVKRTNLEVYNKEKTYYELTKSCGVVAEHDFFIFDIDGSRVPHIVRRNLSKYTMLDLCYALRHFDRNDCSILCEILCEYADCKESYFSKKDWYDFVENPDIINIYKKLGPIFNRALLNTVIFADTLVEVGLVGVLTLDNQDLYGQWYDFGDFIQTAPGFGVAVADSYYSYMMPMLTMCHVLDCELFVNDSYRQFDLVQYDFTDYKLELFNKYFKYWGMKYHPNTVDCDNDRCIIHCANFNILFSMVLPNTCFGPLVRQIFVDGVPFVVSIGYHYKELGVVMNLDVDTHRYRLSLKDLLLYAADPAMHVASASALLDLRTCCFSVAAITSGIKFQTVKPGNFNQDFYEFVKSKGLFKEGSTVDLKHFFFTQDGNAAITDYNYYKYNLPTMVDIKQLLFVLEVVYKYFEIYDGGCIPASQVIVNNYDKSAGYPFNKFGKARLYYEALSFEEQNEIYAYTKRNVLPTLTQMNLKYAISAKNRARTVAGVSILSTMTGRMFHQKCLKSIAATRGVPVVIGTTKFYGGWDDMLRHLIKDVDNPVLMGWDYPKCDRAMPNILRIVSSLVLARKHEFCCSHGDRFYRLANECAQVLSEIVMCGGCYYVKPGGTSSGDATTAFANSVFNICQAVTANVCSLMACNGHKIEDLSIRNLQKRLYSNVYRTDYVDYTFVNEYYEFLCKHFSMMILSDDGVVCYNSDYASKGYIANISVFQQVLYYQNNVFMSESKCWVENDITNGPHEFCSQHTMLVKIDGDYVYLPYPDPSRILGAGCFVDDLLKTDSVLLIERFVSLAIDAYPLVYHENEEYQKVFRVYLEYIKKLYNDLGTQILDSYSVILSTCDGLKFTEESFYKNMYLKSAVMQ

SEQ ID NO: 2930 - DNA, 2784 bp, Corononavirus-HKU1
  CDS (1)..(2784)
tctaaagatttaaattttttaaaccgggttaggggtactagtgtgaatgcccggctagtaccctgtgctagtggtttatctactgatgttcaattaagggcatttgacatttgtaataccaatagagctggtataggtttatattataaagtgaattgttgccgttttcagcgtatagatgacgacggtaataaattggataagttctttgttgtcaaaagaactaatttagaagtttataataaagagaaaacttattatgagttgactaaaagttgtggtgttgtggctgaacatgatttctttacatttgatattgatggtagtcgcgtgccacatatagttcgtaggaatctttcaaagtatactatgttagatctttgctatgcattgcgtcattttgatcgtaatgattgttcaatattgtgtgaaattctttgtgagtatgctgattgtaaagaatcctacttttctaagaaagattggtatgattttgttgaaaatcctgatattattaatatatataaaaaattaggtcctatttttaatagagctttacttaatactgtcatttttgcagacaccttagttgaagtaggtttagttggtgttttaactttagataaccaagatttgtatggtcaatggtatgattttggtgattttatacaaacagccccaggatttggtgtggcagtcgcagattcttactattcttatatgatgcctatgttaactatgtgtcatgtattagattgtgaattatttgttaatgatagttatagacaattcgatcttgtacagtatgattttactgattacaagttagagttgtttaataagtattttaagtattggggtatgaagtatcatcctaatactgtggattgtgataatgataggtgtattattcattgtgctaattttaatatactatttagtatggttttacctaatacttgttttggtccccttgttagacaaatttttgtagatggtgtaccgtttgttgtttctattggttaccattacaaagagttaggtgtagttatgaacttagatgttgacacacaccgttatcgcttgtctcttaaagatttacttctttatgcagcagatcctgctatgcatgttgcatctgctagtgctctgcttgatttacgaacttgttgttttagtgtagctgccattacaagtggtataaaatttcaaactgttaaaccaggtaactttaaccaagacttttacgagtttgttaaaagtaaaggcttgtttaaagagggtagtacagttgatttgaaacattttttctttactcaagatggtaatgctgcaattactgattataattattataagtataatttacctactatggttgatattaagcagttattgtttgtattagaagttgtttataaatattttgaaatttatgatggtggttgtataccagcatcacaagttattgttaataattatgataaaagtgctggttatccatttaataaatttggtaaagccagactttattatgaggcattatcatttgaggaacagaatgaaatttatgcatatactaaacgtaatgttctgcccaccttaactcaaatgaatttaaaatatgctatcagtgctaagaatagagctcgcactgtagcaggtgtttctattcttagtactatgacaggccgaatgttccatcaaaaatgtttgaagagtatagcagccacccgaggtgttcctgttgttataggaaccactaaattttatggtggttgggacgatatgttacgtcatcttataaaggatgttgacaaccctgttcttatgggttgggattatcctaaatgtgatcgtgctatgccaaatattttgcgtattgttagtagtttagttttggcccgcaaacatgaattttgttgttcacatggtgatagattctatcgccttgcgaatgaatgtgcacaagttttgagtgaaatagttatgtgtggcggttgctattatgttaagcctggtggtactagcagtggtgatgcaactactgcttttgctaattctgtttttaatatatgtcaggctgttactgctaatgtttgttctcttatggcctgtaatggccataagattgaagatttaagtatacgcaatttacaaaaacgcttatactctaatgtttatcgtacagattatgttgattatacatttgttaatgagtattatgaatttttatgtaagcattttagtatgatgattttgagtgatgatggtgttgtctgttataactctgattatgctaataagggttatatagctaatataagtgcttttcaacaagttttgtactatcagaataatgtctttatgtctgaatctaaatgttgggttgaaaatgatattactaatggtcctcatgaattttgttcccaacatactatgttggttaagatagatggtgattatgtttatttaccatatccagatccttctagaatcttaggagctggttgttttgttgatgatttattgaagactgacagtgttcttttgatagagcgctttgtaagtctagctatagatgcttaccctttagtatatcatgaaaatgaagaataccaaaaagtctttcgcgtatatttagaatatataaaaaaactgtataatgatcttggtactcagatcttagatagttatagtgttattttaagtacttgtgatggtttaaagtttactgaagaatcattttacaagaatatgtatttaaaaagtgccgtgatgcag

SEQ ID NO: 2931 - protein, 928 aa, Corononavirus-HKU1
SKDLNFLNRVRGTSVNARLVPCASGLSTDVQLRAFDICNTNRAGIGLYYKVNCCRFQRIDDDGNKLDKFFVVKRTNLEVYNKEKTYYELTKSCGVVAEHDFFTFDIDGSRVPHIVRRNLSKYTMLDLCYALRHFDRNDCSILCEILCEYADCKESYFSKKDWYDFVENPDIINIYKKLGPIFNRALLNTVIFADTLVEVGLVGVLTLDNQDLYGQWYDFGDFIQTAPGFGVAVADSYYSYMMPMLTMCHVLDCELFVNDSYRQFDLVQYDFTDYKLELFNKYFKYWGMKYHPNTVDCDNDRCIIHCANFNILFSMVLPNTCFGPLVRQIFVDGVPFVVSIGYHYKELGVVMNLDVDTHRYRLSLKDLLLYAADPAMHVASASALLDLRTCCFSVAAITSGIKFQTVKPGNFNQDFYEFVKSKGLFKEGSTVDLKHFFFTQDGNAAITDYNYYKYNLPTMVDIKQLLFVLEVVYKYFEIYDGGCIPASQVIVNNYDKSAGYPFNKFGKARLYYEALSFEEQNEIYAYTKRNVLPTLTQMNLKYAISAKNRARTVAGVSILSTMTGRMFHQKCLKSIAATRGVPVVIGTTKFYGGWDDMLRHLIKDVDNPVLMGWDYPKCDRAMPNILRIVSSLVLARKHEFCCSHGDRFYRLANECAQVLSEIVMCGGCYYVKPGGTSSGDATTAFANSVFNICQAVTANVCSLMACNGHKIEDLSIRNLQKRLYSNVYRTDYVDYTFVNEYYEFLCKHFSMMILSDDGVVCYNSDYANKGYIANISAFQQVLYYQNNVFMSESKCWVENDITNGPHEFCSQHTMLVKIDGDYVYLPYPDPSRILGAGCFVDDLLKTDSVLLIERFVSLAIDAYPLVYHENEEYQKVFRVYLEYIKKLYNDLGTQILDSYSVILSTCDGLKFTEESFYKNMYLKSAVMQ

SEQ ID NO: 2932 - DNA, 2784 bp, Corononavirus-HKU1
  CDS (1)..(2784)
tctaaagatttaaattttttaaaccgggttcggggtactagtgtgaatgcccggctagtaccctgtgctagtggtttatctactgatgttcaattaagggcatttgacatttgtaataccaatagagctggtataggtttatattataaagtgaattgttgccgttttcagcgtatagatgacgacggtaataaattggataagttctttgttgtcaaaagaactaatttagaagtttataataaagagaaaacttattatgagttgactaaaagttgtggtgttgtggctgaacatgatttctttacatttgatattgatggtagtcgcgtgccacatatagttcgtaggaatctttcaaagtatactatgttagatctttgctatgcattgcgtcattttgatcgtaatgattgttcaatattgtgtgaaattctttgtgagtatgctgattgtaaagaatcctacttttctaagaaagattggtatgattttgttgaaaatcctgatattattaatatatataaaaaattaggccctatttttaatagagctttacttaatactgtcatttttgcagacaccttagttgaagtaggtttagttggtgttttaactttagataaccaagatttgtatggtcaatggtatgattttggtgattttatacaaacagccccaggatttggtgtggcagtcgcagattcttactattcttatatgatgcctatgttgactatgtgtcatgtattagattgtgaattatttgttaatgatagttatagacaattcgatcttgtgcagtatgattttactgattacaagttagagttgtttaataagtattttaagtattggggtatgaagtatcatcctaatactgtggattgtgataatgataggtgtattattcattgtgctaattttaatatactatttagtatggttttacctaatacttgttttggtccccttgttagacaaatttttgtagatggtgtaccgtttgttgtttctattggttaccattacaaagagttaggtgtagttatgaacttagatgttgacacacaccgttatcgtttgtctcttaaagatttacttctttatgcagcagatcctgctatgcatgttgcatctgctagtgctctgcttgatttacgaacttgttgttttagtgtagctgccattacaagtggtataaaatttcaaactgtaaaaccaggtaactttaaccaagacttttacgagtttgttaaaagtaaaggcttgtttaaagagggtagtacagttgatttgaaacattttttctttactcaagatggtaatgctgcaattactgattataattattataagtataatttacctactatggttgatattaagcagttattgtttgtattagaagttgtttataaatattttgaaatttatgatggtggttgtataccagcatcacaagtcattgttaataattatgataaaagtgctggttatccatttaataaatttggtaaagccagactttattatgaggcattatcatttgaagaacagaatgaaatttatgcatatactaaacgtaatgttctgcccaccttaactcaaatgaatttaaaatatgctatcagtgctaagaatagagctcgcactgtagcaggtgtttctattcttagtactatgacaggccgaatgttccatcaaaaatgtttgaagagtatagcagctacccgaggtgttcctgttgttataggaaccactaaattttatggtggttgggacgatatgttacgtcatcttataaaggatgttgacaaccctgttcttatgggttgggattatcctaaatgtgatcgtgctatgccaaatattttgcgtattgttagtagtttagttttggcccgcaaacatgaattttgttgttcacatggtgatagattttatcgccttgcgaatgaatgtgctcaagttttgagtgaaatagttatgtgtggcggttgctattatgttaagcctggtggtactagcagtggtgatgcaactactgcttttgctaattctgtttttaatatatgtcaggctgttactgctaacgtttgttctcttatggcctgtaatggccataagattgaagatttaagtatacgcaatttacaaaaacgcttatactctaatgtttatcgtacagattatgttgattatacatttgttaatgagtattatgaatttttatgtaagcattttagtatgatgattttgagtgatgatggtgttgtctgttataactctgattatgctagtaagggttatatagctaatataagtgtttttcaacaagttttgtactatcagaataatgtttttatgtctgaatctaaatgttgggttgaaaatgatattactaatggtcctcatgaattttgttcccaacatactatgttggttaagatagatggtgattatgtttatttaccatatccagatccttctagaattctaggagctggttgttttgttgatgatttattgaagactgatagtgttcttttgatagagcgctttgtaagtctagctatagatgcttaccctttagtatatcatgaaaatgaagaataccaaaaagtctttcgtgtatatttagaatatataaaaaaactgtataatgatcttggtactcagatcttagatagttatagtgttattttaagtacttgtgatggtttaaagtttactgaagaatcattttacaagaatatgtatttaaaaagtgccgtgatgcag

SEQ ID NO: 2933 - protein, 928 aa, Corononavirus-HKU1; identical to SEQ ID NO: 2925

SEQ ID NO: 2934 - DNA, 2784 bp, Corononavirus-HKU1; identical to SEQ ID NO: 2924
  CDS (1)..(2784)

SEQ ID NO: 2935 - protein, 928 aa, Corononavirus-HKU1; identical to SEQ ID NO: 2925

SEQ ID NO: 2936 - DNA, 4056 bp, Corononavirus-HKU1
  CDS (1)..(4056)
atgtttttaattatttttattttgcctacaacactagctgttataggtgattttaattgtactaactcttttattaatgattataataaaaccattccgcgtataagcgaggatgttgttgatgtatctcttggtttgggcacatattatgttcttaaccgtgtttatttaaatactaccttgttatttacaggttattttcctaaatctggtgctaattttagagacttggctttaaagggttctaaatatttgagtactctctggtataaaccaccttttctgtcagattttaataatggtattttttctaaggttaagaatactaagttatatgttaataatactttgtatagtgaatttagtactatagttataggtagtgtttttgttaatacttcttatactattgttgttcaacctcacaatggtattttggagattacagcttgtcagtatactatgtgtgaatatcctcacactgtttgtaagtctaagggtagtattcgtaatgaatcttggcacattgattcttcggaacctttatgcttgtttaagaaaaattttacttataatgtttctgcagattggctgtattttcatttttatcaagaacgtggtgttttttatgcatattatgcagatgtaggtatgcctaccactttcttatttagtttatatttaggtactattttatctcattattatgttatgcctttgacttgtaaggctatatcttcaaatactgacaatgaaactttagaatattgggttacaccgctatctagacgtcagtatcttcttaattttgatgagcacggtgttattactaatgccgttgattgttcaagtagttttcttagtgagattcaatgtaaaactcaatcttttgcacctaatactggtgtttatgatttgtctggttttactgtaaagcctgttgcaactgtttatcgtcggattcctaatttacctgattgtgacattgacaactggcttaataatgttagtgtaccttcacctcttaattgggaacgtagaattttttctaattgtaacttcaatttaagcactttacttcgtctagttcatgttgattctttttcttgtaataatcttgataaatctaaaatttttggtagttgctttaatagtattactgttgacaagtttgctatacctaatcgcagacgagatgatttgcaattgggcagttctggctttttgcaatcatctaattacaaaatagatatttcttctagttcttgtcaattgtattatagtttacctttagttaatgttactattaataactttaatccatcttcttggaataggaggtatggttttggtagttttaatgtgtcttcttatgacgttgtttattctgatcattgtttttctgttaacagcgacttttgcccttgtgcagatccgtctgttgttaattcttgtgttaaatctaagcctctttctgccatttgtcctgctggtactaaatatcgtcattgcgacttggatactactctttatgttaataactggtgtagatgttcttgtctacctgaccccatttctacttattctcctaacacatgtcctcaaaagaaggtcgttgttggtataggtgaacattgtccaggtcttggtattaatgaggaaaaatgtggtacacaattaaatcatagttcctgttcttgtagtcctgatgcctttttgggttggtcttttgatagttgtattagtaataatcgttgcaatattttttctaattttatttttaatggaattaatagtggcaccacttgttctaatgatttgttatattctaacactgaagtttctactggtgtttgtgttaattatgatctttatggcatcacaggccaaggtatttttaaagaagtttctgcggcttattataataattggcagaatcttttgtatgattctaatggtaatattattggttttaaagattttttgactaataaaacttacactatacttccttgttattctggtagagtgtctgctgcattttatcaaaattcttcttcaccagctttgctttatcgtaatttaaagtgtagttatgttttgaataatatttcttttatctcacaaccattttattttgatagttatcttggttgtgttttgaatgctgttaatttaactagctattctgtatcctcttgtgatttgcgtatgggtagtgggttttgtattgattatgctttaccctcttctcggcgtaagcgtagaggtatttcttctccttatcgctttgtaacttttgaaccctttaatgttagttttgttaacgatagtgttgaaactgttggtggtttatttgagattcagattcctactaactttaccatagctggtcatgaagaatttattcagactagttctcctaaagttactattgattgttcagcttttgtttgctctaattatgctgcttgtcatgatttattgtcggaatatggcactttttgcgataatattaatagtattttaaatgaagtcaatgatttacttgatattactcagttgcaggttgctaatgctttaatgcaaggtgttacacttagttctaatcttaatactaatctacactctgatgttgataatatagattttaaatctcttctaggttgtttaggttcacaatgtggttcttcgtctagatctttgttagaggatttattattcaacaaggtcaaactttcagatgtaggttttgttgaagcttataataattgcactggtggtagtgaaattagagatcttctctgtgtgcaatcttttaatggtattaaagtattacctcccattttatctgagactcaaatttctggctatactacagctgctactgtggcggctatgtttccgccatggtctgctgctgctggtgtaccattttctcttaatgtacaatatagaattaatggtttgggtgttactatggatgttcttaataagaatcaaaagttaatagctaatgcttttaataaagctcttctttctatccagaatggttttactgctactaactctgctcttgctaaaattcaaagtgtcgttaatgctaatgctcaagcacttaatagtttgttacaacaattatttaataaatttggtgctattagttcttctttacaagaaattttgtctcgccttgataatttagaagctcaggttcagattgataggctcattaatggtcgtttgactgctttaaatgcttatgtttctcaacagcttagtgatattacacttattaaggctggagcttctcgtgctattgagaaggttaatgagtgtgttaaaagtcaatcccctcgtataaatttttgtggcaatggtaaccacattttatcattggttcaaaatgctccttatggtttgcttttcattcattttagttataaacctacttcttttaaaactgtcttagtaagtccaggtttatgtttatccggtgatagaggtattgcacctaagcaaggttattttattaaacaaaatgattcctggatgtttactggtagttcctattattacccagaaccaatttcagataaaaatgttgttttcatgaatagttgctctgttaattttactaaagctccatttatttatcttaataattctataccaaatttgtctgattttgaagccgagttttctctttggtttaaaaatcatacttctatagcacctaatttaacctttaattctcatattaatgctacttttttagatctgtattatgaaatgaatgttattcaggaatctattaaatctttgaacagtagttttattaatcttaaagaaataggtacttatgaaatgtatgttaaatggccttggtacatttggttgttaattgtcattttatttataatttttcttatgatacttttctttatatgctgctgtactggttgtggttcagcatgttttagtaaatgtcataattgttgtgatgagtatgggggtcacaatgattttgttattaaagcatctcatgatgattag

SEQ ID NO: 2937 - protein, 1351 aa, Corononavirus-HKU1
MFLIIFILPTTLAVIGDFNCTNSFINDYNKTIPRISEDVVDVSLGLGTYYVLNRVYLNTTLLFTGYFPKSGANFRDLALKGSKYLSTLWYKPPFLSDFNNGIFSKVKNTKLYVNNTLYSEFSTIVIGSVFVNTSYTIVVQPHNGILEITACQYTMCEYPHTVCKSKGSIRNESWHIDSSEPLCLFKKNFTYNVSADWLYFHFYQERGVFYAYYADVGMPTTFLFSLYLGTILSHYYVMPLTCKAISSNTDNETLEYWVTPLSRRQYLLNFDEHGVITNAVDCSSSFLSEIQCKTQSFAPNTGVYDLSGFTVKPVATVYRRIPNLPDCDIDNWLNNVSVPSPLNWERRIFSNCNFNLSTLLRLVHVDSFSCNNLDKSKIFGSCFNSITVDKFAIPNRRRDDLQLGSSGFLQSSNYKIDISSSSCQLYYSLPLVNVTINNFNPSSWNRRYGFGSFNVSSYDVVYSDHCFSVNSDFCPCADPSVVNSCVKSKPLSAICPAGTKYRHCDLDTTLYVNNWCRCSCLPDPISTYSPNTCPQKKVVVGIGEHCPGLGINEEKCGTQLNHSSCSCSPDAFLGWSFDSCISNNRCNIFSNFIFNGINSGTTCSNDLLYSNTEVSTGVCVNYDLYGITGQGIFKEVSAAYYNNWQNLLYDSNGNIIGFKDFLTNKTYTILPCYSGRVSAAFYQNSSSPALLYRNLKCSYVLNNISFISQPFYFDSYLGCVLNAVNLTSYSVSSCDLRMGSGFCIDYALPSSRRKRRGISSPYRFVTFEPFNVSFVNDSVETVGGLFEIQIPTNFTIAGHEEFIQTSSPKVTIDCSAFVCSNYAACHDLLSEYGTFCDNINSILNEVNDLLDITQLQVANALMQGVTLSSNLNTNLHSDVDNIDFKSLLGCLGSQCGSSSRSLLEDLLFNKVKLSDVGFVEAYNNCTGGSEIRDLLCVQSFNGIKVLPPILSETQISGYTTAATVAAMFPPWSAAAGVPFSLNVQYRINGLGVTMDVLNKNQKLIANAFNKALLSIQNGFTATNSALAKIQSVVNANAQALNSLLQQLFNKFGAISSSLQEILSRLDNLEAQVQIDRLINGRLTALNAYVSQQLSDITLIKAGASRAIEKVNECVKSQSPRINFCGNGNHILSLVQNAPYGLLFIHFSYKPTSFKTVLVSPGLCLSGDRGIAPKQGYFIKQNDSWMFTGSSYYYPEPISDKNVVFMNSCSVNFTKAPFIYLNNSIPNLSDFEAEFSLWFKNHTSIAPNLTFNSHINATFLDLYYEMNVIQESIKSLNSSFINLKEIGTYEMYVKWPWYIWLLIVILFIIFLMILFFICCCTGCGSACFSKCHNCCDEYGGHNDFVIKASHDD

SEQ ID NO: 2938 - DNA, 4071 bp, Corononavirus-HKU1
  CDS (1)..(4071)
atgttattaattatttttattttgcctacaacattagctgttataggtgattttaattgtactaattttgctattaatgatttaaacaccacagttcctcgcataagtgagtatgttgtggatgtttcttatggtttgggtacatattatatacttgatcgtgtttatttaaatactactatattatttactggttatttccctaaatctggtgccaattttagggatctatctttaaaaggtactacatatttgagtactctttggtatcagaaaccctttttatctgattttaataatggtattttttctagagttaagaatactaagttgtatgttaataaaactttgtatagtgagtttagtactatagttataggtagtgtttttattaacaactcttatactattgttgttcaacctcataatggtgttttggagattacagcttgtcaatacactatgtgtgagtatcctcatactatttgtaaatctaaaggtagttctcgtaatgaatcttggcattttgataaatctgaacctttgtgtctgttcaagaaaaattttacttataatgtttctacagattggttgtattttcatttttatcaagaacgtggcactttttatgcttattatgctgattctggcatgcctactacttttttatttagtttgtatcttggtactcttttatctcattattatgttttgcctttgacttgtaatgctatatcttctaatactgataatgagactttacaatattgggttacacctttgtctaaacgccaatatcttcttaaatttgacaaccgtggtgttattactaatgctgttgattgttctagtagtttctttagcgagattcaatgtaaaactaaatctttattacctaatactggtgtttatgacttatctggttttactgttaagcctgttgcaactgtacatcgtcgtattcctgatttacctgattgtgacattgataaatggcttaacaattttaatgtaccctcacctcttaattgggaacgtaaaattttttctaattgcaactttaatttgagtactttgcttcgtttagttcatactgattctttttcttgtaataattttgatgaatctaagatatatggtagttgttttaagagtattgttttagataaatttgccatacccaactccagacgatctgatttgcagttgggcagttctggttttctgcaatcttctaattataaaattgacactacttctagttcttgtcaattgtattatagtttgcctgcaattaatgttactattaataattataatccttcttcttggaatagaaggtatggttttaataattttaatttgagctctcatagtgttgtttactcacgttattgtttttctgttaataatactttttgtccttgtgctaaaccttcttttgcttcaagttgcaagagtcataaaccaccttctgcttcctgtcctattggtactaattatcgttcttgtgagagtactactgtactcgaccacactgactggtgtaggtgttcttgtttacctgatcctataactgcttatgaccctaggtcttgttctcaaaaaaagtctctggttggtgttggtgaacattgtgcagggttcggtgttgatgaagaaaagtgtggtgtattggatggatcatataatgtttcttgtctttgtagtactgatgcctttctaggttggtcttatgacacttgcgtcagtaacaaccgttgtaatattttttctaattttattttaaatggtatcaatagtggtaccacttgttctaatgatttattgcagcctaatactgaagtttttactgatgtttgtgttgattacgacctttatggtattacaggacaaggtatttttaaagaagtttctgctgtttattataatagttggcaaaatcttttgtatgattctaatggcaacattattggttttaaagattttgttactaataaaacatataatattttcccttgttatgcaggaagagtttctgctgcttttcatcaaaatgcttcctctttggctttactttatcgtaatttaaaatgtagctatgttttgaataatatttctttagctactcagccatattttgatagttatcttggttgcgtttttaatgctgataatttaactgattattctgtttcttcttgtgctcttcgcatgggtagtggtttttgtgttgattataactcaccttcttcttcctcttcgcgtcgtaaacgtagaagtatttctgcttcttatcgttttgttacttttgaaccctttaatgtcagttttgttaatgacagtattgagtctgtgggtggtctttatgagatcaaaattcccactaactttactatagttggtcaagaggaatttattcaaactaattctcctaaagttactattgattgttctttatttgtctgttctaattatgcagcttgccatgacttattgtcagagtatggcactttttgtgataatattaatagtattttagatgaagttaatggtttacttgatactactcaattgcatgtagctgatactcttatgcaaggtgtcacacttagctccaatcttaatactaatttgcattttgatgttgataatattaattttaaatccctagttggatgtttaggtccacactgcggttcttcttctcgttctttttttgaagatttattgtttgacaaagttaaactttcagatgttggttttgttgaagcttataacaattgtactggtggtagtgaaattagagatcttctttgtgtacaatcctttaatggtattaaagttttgcctcctattttgtctgaatctcaaatttctggttacaccacagccgctactgttgctgctatgtttccaccatggtcagcagcagctggcataccattttctcttaatgtacaatatagaattaatggtttgggtgttactatggatgttcttaataaaaatcaaaagttgatagctactgcttttaataatgctcttctttctattcagaatggttttagtgctaccaactctgcacttgctaaaatacaaagtgttgttaattctaatgctcaagcacttaatagtttgttacagcaattatttaataaatttggtgcaattagttcttctttacaagaaattttatctcgtctcgatgttttagaggctcaggttcagattgataggcttattaatggtcgtttaactgctttaaatgcttatgtctctcaacagcttagtgatatttctcttgtaaaatttggtgctgctttagctatggagaaggttaatgagtgtgttaaaagtcaatctcctcgtattaatttttgtggtaatggtaatcatattttgtcattagttcaaaatgctccttatggtttgttgtttatgcattttagttataaacctatttcttttaaaactgttttagtaagtcctggtttgtgtatatcaggtgatgtaggtattgcacctaaacaagggtattttattaaacataatgatcattggatgttcactggtagttcttactattatcctgaaccaatttcagataaaaatgttgtttttatgaatacttgttctgttaattttactaaagcgcctcttgtttatttgaatcattctgtaccaaaattgtctgattttgaatctgagttatctcattggtttaaaaatcaaacatccattgcgcctaatttgactttaaatcttcatactattaatgctacttttttagatttgtattatgagatgaatcttattcaagagtctattaagtctttgaataatagttatatcaatcttaaagatataggtacatatgaaatgtatgtaaaatggccttggtatgtttggctactaatttctttttcatttataatattccttgtattgctcttttttatatgttgttgtactggttgtggttctgcatgttttagtaaatgtcataattgttgtgatgagtatggtggtcatcatgattttgttatcaaaacatctcatgatgattag

SEQ ID NO: 2939 - protein, 1356 aa, Homo sapiens
MLLIIFILPTTLAVIGDFNCTNFAINDLNTTVPRISEYVVDVSYGLGTYYILDRVYLNTTILFTGYFPKSGANFRDLSLKGTTYLSTLWYQKPFLSDFNNGIFSRVKNTKLYVNKTLYSEFSTIVIGSVFINNSYTIVVQPHNGVLEITACQYTMCEYPHTICKSKGSSRNESWHFDKSEPLCLFKKNFTYNVSTDWLYFHFYQERGTFYAYYADSGMPTTFLFSLYLGTLLSHYYVLPLTCNAISSNTDNETLQYWVTPLSKRQYLLKFDNRGVITNAVDCSSSFFSEIQCKTKSLLPNTGVYDLSGFTVKPVATVHRRIPDLPDCDIDKWLNNFNVPSPLNWERKIFSNCNFNLSTLLRLVHTDSFSCNNFDESKIYGSCFKSIVLDKFAIPNSRRSDLQLGSSGFLQSSNYKIDTTSSSCQLYYSLPAINVTINNYNPSSWNRRYGFNNFNLSSHSVVYSRYCFSVNNTFCPCAKPSFASSCKSHKPPSASCPIGTNYRSCESTTVLDHTDWCRCSCLPDPITAYDPRSCSQKKSLVGVGEHCAGFGVDEEKCGVLDGSYNVSCLCSTDAFLGWSYDTCVSNNRCNIFSNFILNGINSGTTCSNDLLQPNTEVFTDVCVDYDLYGITGQGIFKEVSAVYYNSWQNLLYDSNGNIIGFKDFVTNKTYNIFPCYAGRVSAAFHQNASSLALLYRNLKCSYVLNNISLATQPYFDSYLGCVFNADNLTDYSVSSCALRMGSGFCVDYNSPSSSSSRRKRRSISASYRFVTFEPFNVSFVNDSIESVGGLYEIKIPTNFTIVGQEEFIQTNSPKVTIDCSLFVCSNYAACHDLLSEYGTFCDNINSILDEVNGLLDTTQLHVADTLMQGVTLSSNLNTNLHFDVDNINFKSLVGCLGPHCGSSSRSFFEDLLFDKVKLSDVGFVEAYNNCTGGSEIRDLLCVQSFNGIKVLPPILSESQISGYTTAATVAAMFPPWSAAAGIPFSLNVQYRINGLGVTMDVLNKNQKLIATAFNNALLSIQNGFSATNSALAKIQSVVNSNAQALNSLLQQLFNKFGAISSSLQEILSRLDVLEAQVQIDRLINGRLTALNAYVSQQLSDISLVKFGAALAMEKVNECVKSQSPRINFCGNGNHILSLVQNAPYGLLFMHFSYKPISFKTVLVSPGLCISGDVGIAPKQGYFIKHNDHWMFTGSSYYYPEPISDKNVVFMNTCSVNFTKAPLVYLNHSVPKLSDFESELSHWFKNQTSIAPNLTLNLHTINATFLDLYYEMNLIQESIKSLNNSYINLKDIGTYEMYVKWPWYVWLLISFSFIIFLVLLFFICCCTGCGSACFSKCHNCCDEYGGHHDFVIKTSHDD

SEQ ID NO: 2940 - DNA, 4071 bp, Corononavirus-HKU1
  CDS (1)..(4071)
atgttattaattatttttattttgcctacaacattagctgttataggtgattttaattgtactaattttgctattaatgatttaaacaccacagttcctcgcataagtgagtatgttgtggatgtttcttatggtttgggtacatattatatacttgatcgtgtttatttaaatactactatattatttactggttatttccctaaatctggtgccaattttagggatctatctttaaaaggtactacatatttgagtactctttggtatcagaaaccctttttatctgattttaataatggtattttttctagagttaagaatactaagttgtatgttaataaaactttgtatagtgagtttagtactatagttataggtagtgtttttattaacaactcttatactattgttgttcaacctcataatggtgttttggagattacagcttgtcaatacactatgtgtgagtatcctcatactatttgtaaatctaaaggtagttctcgtaatgaatcttggcattttgataaatctgaacctttgtgtctgttcaagaaaaattttacttataatgtttctacagattggttgtattttcatttttatcaagaacgtggcactttttatgcttattatgctgattctggcatgcctactacttttttatttagtttgtatcttggtactcttttatctcattattatgttttgcctttgacttgtaatgctatatcttctaatactgataatgagactttacaatattgggtcacacctttgtctaaacgccaatatcttcttaaatttgacaaccgtggtgttattactaatgctgttgattgttctagtagtttctttagcgagattcaatgtaaaactaaatctttattacctaatactggtgtttatgacttatctggttttactgttaagcctgttgcaactgtacatcgtcgtattcctgatttacctgattgtgacattgataaatggcttaacaattttaatgtaccctcacctcttaattgggaacgtaaaattttttctaattgcaactttaatttgagtactttgcttcgtttagttcatactgattctttttcttgtaataattttgatgaatctaagatatatggtagttgttttaagagtattgttttagataaatttgctatacccaactccagacgatctgatttgcagttgggcagttctggttttctgcaatcttctaattataaaattgacactacttctagttcttgtcaattgtattatagtttgcctgcaattaatgttactattaataattataatccttcttcttggaatagaaggtatggttttaataattttaatttgagctctcatagtgttgtttactcacgttattgtttttctgttaataatactttttgtccttgtgctaaaccttcttttgcttcaagttgcaagagtcataaaccaccttctgcttcctgtcctattggtactaattatcgttcttgtgagagtactactgtactcgaccacactgactggtgtaggtgttcttgtttacctgatcctataactgcttatgaccctaggtcttgttctcaaaaaaagtctctggttggtgttggtgaacattgtgcagggttcggtgttgatgaagaaaagtgtggtgtattggatggatcatataatgtttcttgtctttgtagtactgatgcctttctaggttggtcttatgacacttgcgtcagtaacaaccgttgtaatattttttctaattttattttaaatggtatcaatagtggtaccacttgttctaatgatttattgcagcctaatactgaagtttttactgatgtttgtgttgattacgacctttatggtattacaggacaaggtatttttaaagaagtttctgctgtttattataatagttggcaaaatcttttgtatgattctaatggcaacattattggttttaaagattttgttactaataaaacatataatattttcccttgttatgcaggaagagtttctgctgcttttcatcaaaatgcttcctctttggctttactttatcgtaatttaaaatgtagctatgttttgaataatatttctttagctactcagccatattttgatagttatcttggttgcgtttttaatgctgataatttaactgattattctgtttcttcttgtgctcttcgcatgggtagtggtttttgtgttgattataactcaccttcttcttcctcttcgcgtcgtaaacgtagaagtatttctgcttcttatcgttttgttacttttgaaccctttaatgtcagttttgttaatgacagtattgagtctgtgggtggtctttatgagatcaaaattcccactaactttactatagttggtcaagaggaatttattcaaactaattctcctaaagttactattgattgttctttatttgtctgttctaattatgcagcttgccatgacttattgtcagagtatggcactttttgtgataatattaatagtattttagatgaagttaatggtttacttgatactactcaattgcatgtagctgatactcttatgcaaggtgtcacacttagctccaatcttaatactaatttgcattttgatgttgataatattaattttaaatccctagttggatgtttaggtccacactgcggttcttcttctcgttctttttttgaagatttattgtttgacaaagttaaactttcagatgttggttttgttgaagcttataacaattgtactggtggtagtgaaattagagatcttctttgtgtacaatcctttaatggtattaaagttttgcctcctattttgtctgaatctcaaatttctggttacaccacagccgctactgttgctgctatgtttccaccatggtcagcagcagctggcataccattttctcttaatgtacaatatagaattaatggtttgggtgttactatggatgttcttaataaaaatcaaaagttgatagctactgcttttaataatgctcttctttctattcagaatggttttagtgctaccaactctgcacttgctaaaatacaaagtgttgttaattctaatgctcaagcacttaatagtttgttacagcaattatttaataaatttggtgcaattagttcttctttacaagaaattttatctcgtctcgatgctttagaggctcaggttcagattgataggcttattaatggtcgtttaactgctttaaatgcttatgtctctcaacagcttagtgatatttctcttgtaaaatttggtgctgctttagctatggagaaggttaatgagtgtgttaaaagtcaatctcctcgtattaatttttgtggtaatggtaatcatattttgtcattagttcaaaatgctccttatggtttgttgtttatgcattttagttataaacctatttcttttaaaactgttttagtaagtcctggtttgtgtatatcaggtgatgtaggtattgcacctaaacaagggtattttattaaacataatgatcattggatgttcactggtagttcttactattatcctgaaccaatttcagataaaaatgttgtttttatgaatacttgttctgttaattttactaaagcgcctcttgtttatttgaatcattctgtaccaaaattgtctgattttgaatctgagttatctcattggtttaaaaatcaaacatccattgcgcctaatttgactttaaatcttcatactattaatgctacttttttagatttgtattatgagatgaatcttattcaagagtctattaagtctttgaataatagttatatcaatcttaaagatataggtacatatgaaatgtatgtaaaatggccttggtatgtttggctactaatttctttttcatttataatattccttgtattgctcttttttatatgttgttgtactggttgtggttctgcatgttttagtaaatgtcataattgttgtgatgagtatggtggtcatcatgattttgttatcaaaacatctcatgatgattag

SEQ ID NO: 2941 - protein, 1356 aa, Corononavirus-HKU1
MLLIIFILPTTLAVIGDFNCTNFAINDLNTTVPRISEYVVDVSYGLGTYYILDRVYLNTTILFTGYFPKSGANFRDLSLKGTTYLSTLWYQKPFLSDFNNGIFSRVKNTKLYVNKTLYSEFSTIVIGSVFINNSYTIVVQPHNGVLEITACQYTMCEYPHTICKSKGSSRNESWHFDKSEPLCLFKKNFTYNVSTDWLYFHFYQERGTFYAYYADSGMPTTFLFSLYLGTLLSHYYVLPLTCNAISSNTDNETLQYWVTPLSKRQYLLKFDNRGVITNAVDCSSSFFSEIQCKTKSLLPNTGVYDLSGFTVKPVATVHRRIPDLPDCDIDKWLNNFNVPSPLNWERKIFSNCNFNLSTLLRLVHTDSFSCNNFDESKIYGSCFKSIVLDKFAIPNSRRSDLQLGSSGFLQSSNYKIDTTSSSCQLYYSLPAINVTINNYNPSSWNRRYGFNNFNLSSHSVVYSRYCFSVNNTFCPCAKPSFASSCKSHKPPSASCPIGTNYRSCESTTVLDHTDWCRCSCLPDPITAYDPRSCSQKKSLVGVGEHCAGFGVDEEKCGVLDGSYNVSCLCSTDAFLGWSYDTCVSNNRCNIFSNFILNGINSGTTCSNDLLQPNTEVFTDVCVDYDLYGITGQGIFKEVSAVYYNSWQNLLYDSNGNIIGFKDFVTNKTYNIFPCYAGRVSAAFHQNASSLALLYRNLKCSYVLNNISLATQPYFDSYLGCVFNADNLTDYSVSSCALRMGSGFCVDYNSPSSSSSRRKRRSISASYRFVTFEPFNVSFVNDSIESVGGLYEIKIPTNFTIVGQEEFIQTNSPKVTIDCSLFVCSNYAACHDLLSEYGTFCDNINSILDEVNGLLDTTQLHVADTLMQGVTLSSNLNTNLHFDVDNINFKSLVGCLGPHCGSSSRSFFEDLLFDKVKLSDVGFVEAYNNCTGGSEIRDLLCVQSFNGIKVLPPILSESQISGYTTAATVAAMFPPWSAAAGIPFSLNVQYRINGLGVTMDVLNKNQKLIATAFNNALLSIQNGFSATNSALAKIQSVVNSNAQALNSLLQQLFNKFGAISSSLQEILSRLDALEAQVQIDRLINGRLTALNAYVSQQLSDISLVKFGAALAMEKVNECVKSQSPRINFCGNGNHILSLVQNAPYGLLFMHFSYKPISFKTVLVSPGLCISGDVGIAPKQGYFIKHNDHWMFTGSSYYYPEPISDKNVVFMNTCSVNFTKAPLVYLNHSVPKLSDFESELSHWFKNQTSIAPNLTLNLHTINATFLDLYYEMNLIQESIKSLNNSYINLKDIGTYEMYVKWPWYVWLLISFSFIIFLVLLFFICCCTGCGSACFSKCHNCCDEYGGHHDFVIKTSHDD

SEQ ID NO: 2942 - DNA, 4071 bp, Corononavirus-HKU1
  CDS (1)..(4071)
atgttattaattatttttattttgcctacaacattagctgttataggtgattttaattgtactaattttgctattaatgatttaaacaccacagttcctcgcataagtgagtatgttgtggatgtttcttatggtttgggtacatattatatacttgatcgtgtttatttaaatactactatattatttactggttatttccctaaatctggtgccaattttagggatctatctttaaaaggtactacatatttgagtactctttggtatcagaaaccctttttatctgattttaataatggtattttttctagagttaagaatactaagttgtatgttaataaaactttgtatagtgagtttagtactatagttataggtagtgtttttattaacaactcttatactattgttgttcaacctcataatggtgttttggagattacagcttgtcaatacactatgtgtgagtatcctcatactatttgtaaatctaaaggtagttctcgtaatgaatcttggcattttgataaatctgaacctttgtgtctgttcaagaaaaattttacttataatgtttctacagattggttgtattttcatttttatcaagaacgtggcactttttatgcttattatgctgattctggcatgcctactacttttttatttagtttgtatcttggtactcttttatctcattattatgttttgcctttgacttgtaatgctatatcttctaatactgataatgagactttacaatattgggtcacacctttgtctaaacgccaatatcttcttaaatttgacaaccgtggtgttattactaatgctgttgattgttctagtagtttctttagcgagattcaatgtaaaactaaatctttattacctaatactggtgtttatgacttatctggttttactgttaagcctgttgcaactgtacatcgtcgtattcctgatttacctgattgtgacattgataaatggcttaacaattttaatgtaccctcacctcttaattgggaacgtaaaattttttctaattgcaactttaatttgagtactttgcttcgtttagttcatactgattctttttcttgtaataattttgatgaatctaagatatatggtagttgttttaagagtattgttttagataaatttgccatacccaactccagacgatctgatttgcagttgggcagttctggttttctgcaatcttctaattataaaattgacactacttctagttcttgtcaattgtattatagtttgcctgcaattaatgttactattaataattataatccttcttcttggaatagaaggtatggttttaataattttaatttgagctctcatagtgttgtttactcacgttattgtttttctgttaataatactttttgtccttgtgctaaaccttcttttgcttcaagttgcaagagtcataaaccaccttctgcttcctgtcctattggtactaattatcgttcttgtgagagtactactgtactcgaccacactgattggtgtaggtgttcttgtttacctgatcctataactgcttatgaccctaggtcttgttctcaaaaaaagtctctggttggtgttggtgaacattgtgcagggttcggtgttgatgaagaaaagtgtggtgtattggatggatcatataatgtttcttgtctttgtagtactgatgcctttctaggttggtcttatgacacttgcgtcagtaacaaccgttgtaatattttttctaattttattttaaatggtatcaatagtggtaccacttgttctaatgatttattgcagcctaatactgaagtttttactgatgtttgtgttgattacgacctttatggtattacaggacaaggtatttttaaagaagtttctgctgtttattataatagttggcaaaatcttttgtatgattctaatggcaacattattggttttaaagattttgttactaataaaacatataatattttcccttgttatgcaggaagagtttctgctgcttttcatcaaaatgcttcctctttggctttactttatcgtaatttaaaatgtagctatgttttgaataatatttctttagctactcagccatattttgatagttatcttggttgcgtttttaatgctgataatttaactgattattctgtttcttcttgtgctcttcgcatgggtagtggtttttgtgttgattataactcaccttcttcttcctcttcgcgtcgtaaacgtagaagtatttctgcttcttatcgttttgttacttttgaaccctttaatgtcagttttgttaatgacagtattgagtctgtgggtggtctttatgagatcaaaattcccactaactttactatagttggtcaagaggaatttattcaaactaattctcctaaagttactattgattgttctttatttgtctgttctaattatgcagcttgccatgacttattgtcagagtatggcactttttgtgataatattaatagtattttagatgaagttaatggtttacttgatactactcaattgcatgtagctgatactcttatgcaaggtgtcacacttagctccaatcttaatactaatttgcattttgatgttgataatattaattttaaatccctagttggatgtttaggtccacactgcggttcttcttctcgttctttttttgaagatttattgtttgacaaagttaaactttcagatgttggttttgttgaagcttataacaattgtactggtggtagtgaaattagagatcttctttgtgtacaatcctttaatggtattaaagttttgcctcctattttgtctgaatctcaaatttctggttacaccacagccgctactgttgctgctatgtttccaccatggtcagcagcagctggcataccattttctcttaatgtacaatatagaattaatggtttgggtgttactatggatgttcttaataaaaatcaaaagttgatagctactgcttttaataatgctcttctttctattcagaatggttttagtgctaccaactctgcacttgctaaaatacaaagtgttgttaattctaatgctcaagcacttaatagtttgttacagcaattatttaataaatttggtgcaattagttcttctttacaagaaattttatctcgtctcgatgctttagaggctcaggttcagattgataggcttattaatggtcgtttaactgctttaaatgcttatgtctctcaacagcttagtgatatttctcttgtaaaatttggtgctgctttagctatggagaaggttaatgagtgtgttaaaagtcaatctcctcgtattaatttttgtggtaatggtaatcatattttgtcattagttcaaaatgctccttatggtttgttgtttatgcattttagttataaacctatttcttttaaaactgttttagtaagtcctggtttgtgtatatcaggtgatgtaggtattgcacctaaacaagggtattttattaaacataatgatcattggatgttcactggtagttcttactattatcctgaaccaatttcagataaaaatgttgtttttatgaatacttgttctgttaattttactaaagcgcctcttgtttatttgaatcattctgtaccaaaattgtctgattttgaatctgagttatctcattggtttaaaaatcaaacatccattgcgcctaatttgactttaaatcttcatactattaatgctacttttttagatttgtattatgagatgaatcttattcaagagtctattaagtctttgaataatagttatatcaatcttaaagatataggtacatatgaaatgtatgtaaaatggccttggtatgtttggctactaatttctttttcatttataatattccttgtattgctcttttttatatgttgttgtactggttgtggttctgcatgttttagtaaatgtcataattgttgtgatgagtatggtggtcatcatgattttgttatcaaaacatctcatgatgattag

SEQ ID NO: 2943 - protein, 1356 aa, Corononavirus-HKU1; identical to SEQ ID NO: 2941

SEQ ID NO: 2944 - DNA, 4071 bp, Corononavirus-HKU1; identical to SEQ ID NO: 2940
  CDS (1)..(4071)

SEQ ID NO: 2945 - protein, 1356 aa, Corononavirus-HKU1; identical to SEQ ID NO: 2941

SEQ ID NO: 2946 - DNA, 4056 bp, Corononavirus-HKU1
  CDS (1)..(4056)
atgtttttaattatttttattttgcctacaacactagctgttataggtgattttaattgtactaactcttttattaatgattataataaaaccattccgcgtataagcgaggatgttgttgatgtatctcttggtttgggcacatattatgttcttaaccgtgtttatttaaatactaccttgttatttacgggttattttcctaaatctggtgctaactttagagacttggctttaaagggttctatatatttgagtactctctggtataaaccaccttttctgtcagattttaataatggtattttttctaaggttaagaatactaagttatatgttaataatactttgtatagtgaatttagtactatagttataggtagtgtttttgttaatacttcttatactattgttgttcaacctcataatggtattttggagattacagcttgtcagtatactatgtgtgaatatcctcacactgtttgtaagtctaagggtagtattcgtaatgaatcttggcacattgattcttcggaacctttatgcttgtttaagaaaaattttacttataatgtttctgcagattggctgtattttcatttttatcaagaacgtggtgttttttatgcatattatgcagatgtaggtatgcctaccactttcttatttagtctatatttaggtactattttatctcattattatgttatgcctttgacttgtaatgctatatcttcaaatactgacaatgaaactttagaatattgggttacaccgctatctagacgtcagtatcttcttaattttgatgagcacggtgttattactaatgccgttgattgttcaagtagttttcttagtgagattcaatgtaaaactcaatcttttgcacctaatactggtgtttatgatttgtctggttttactgtaaagcctgttgcaactgtttatcgtcggattcctaatttacctgattgtgacattgacaactggcttaataatgttagtgtaccttcacctcttaattgggaacgtagaattttttctaattgtaactttaacttaagcactttacttcgtctagttcatgttgattctttttcttgtaataatcttgataaatctaaaatttttggtagttgctttaatagtattactgttgacaagtttgctatacctaatcgcagacgagatgatttgcaattgggcagttctggctttttgcaatcatctaattacaaaatagatatttcttctagttcttgtcaattgtattatagtttacctttagttaatgttactattaataactttaatccatcttcttggaataggaggtatggttttggtagttttaatttgtcttcttatgacgttgtttattctgatcattgtttttctgttaacagcgacttttgcccttgtgcagatccgtctgttgttaattcttgtgctaaatctaagcctccttctgccatttgtcctgctggtactaaatatcgtcattgcgacttggatactactctttatgttaaaaactggtgtagatgttcttgtctacctgaccccatttctacttattctcctaacacatgtcctcaaaagaaggtcgttgttggtataggtgaacattgtccaggtcttggtattaatgaggaaaaatgtggtacacaattaaatcatagttcctgtttttgtagtcctgatgcctttttgggttggtcttttgatagttgtattagtaataatcgttgcaatattttttctaattttatttttaatggaattaatagtggcaccacttgttctaatgatttgttatattctaacactgaaatttctactggtgtttgtgttaattatgatctttatggcatcacaggccaaggtatttttaaagaagtttctgcggcttattataataattggcagaatcttttgtatgattctaatggtaatattattggttttaaagattttttgactaataaaacttacactatacttccttgttattctggtagagtgtctgctgcattttatcaaaattcttcctcaccagctttgctttatcgtaatttaaagtgtagttatgttttgaataatatttcttttatctcacaaccattttatttcgatagttatcttggttgtgttttgaatgctgttaatttaactagctattctgtatcctcttgtgatttgcgtatgggtagtggattttgtattgattatgctttaccctcttctcggcgtaagcgtagaggtatttcttctccttatcgctttgtaacttttgaaccctttaatgttagttttgttaacgatagtgttgaaactgttggtggtttatttgagattcagattcctactaactttaccatagctggtcatgaagaatttattcagactagttctcctaaagttactattgattgttcagcttttgtttgctctaactatgctgcttgtcatgatttattgtcggaatatggcactttttgcgataatattaatagtattttaaatgaagtcaatgatttacttgatattactcagttgcaggttgctaatgctctaatgcaaggtgttacacttagttctaatcttaatactaatctacactctgatgttgataatatagattttaaatctcttctaggttgtttaggttcacaatgtggttcttcgtctagatctttgttagaggatttattattcaacaaagtcaaactttcagatgtaggttttgttgaagcttataataattgcactggtggtagtgaaattagagatcttctctgtgtgcaatcttttaatggtattaaagtattacctcccattttatctgagactcaaatttctggctatactacagctgctactgtggcggctatgtttccgccatggtctgctgctgctggtgtaccattttctcttaatgtacaatatagaattaatggtttgggtgttactatggatgttcttaataagaatcaaaagttaatagctaatgcttttaataaagctcttctttctatccagaatggttttactgctactaactctgctcttgctaaaattcaaagtgtcgttaatgctaatgctcaagcacttaatagtttgttacaacaattatttaataaatttggtgctattagttcttctttacaagaaattttgtctcgccttgataatttagaagctcaggttcagattgataggctcattaatggtcgtttgactgctttaaatgcttatgtttctcaacagcttagtgatattacacttattaaggctggagcttctcgtgctattgagaaggttaatgagtgtgttaaaagtcaatcccctcgtataaatttttgtggcaatggtaaccacattttatcattggttcaaaatgctccttatggtttgcttttcattcattttagttataaacctacttcttttaaaactgtcttagtaagtccaggtttatgtttatccggtgatagaggtattgcacctaagcaaggttattttattaaacaaaatgattcctggatgtttactggtagttcctattattatccagaaccaatttcagataaaaatgttgttttcatgaatagttgctctgttaattttactaaagctccatttatttatcttaataattctataccaaatttgtctgattttgaagccgagttatctctttggtttaaaaatcatacttctatagcacctaatttaacctttaattctcatattaatgctacttttttagatctgtattatgaaatgaatgttattcaggaatctattaaatctttgaacagtagttttattaatcttaaagaaataggtacttatgaaatgtatgttaaatggccttggtacatttggttgttaattgtcattttatttataatttttcttatgatacttttctttatatgctgctgtactggttgtggttcagcatgttttagtaaatgtcataattgttgtgatgagtatgggggtcacaatgattttgttattaaagcatctcatgatgattag

SEQ ID NO: 2947 - protein, 1351 aa, Corononavirus-HKU1
MFLIIFILPTTLAVIGDFNCTNSFINDYNKTIPRISEDVVDVSLGLGTYYVLNRVYLNTTLLFTGYFPKSGANFRDLALKGSIYLSTLWYKPPFLSDFNNGIFSKVKNTKLYVNNTLYSEFSTIVIGSVFVNTSYTIVVQPHNGILEITACQYTMCEYPHTVCKSKGSIRNESWHIDSSEPLCLFKKNFTYNVSADWLYFHFYQERGVFYAYYADVGMPTTFLFSLYLGTILSHYYVMPLTCNAISSNTDNETLEYWVTPLSRRQYLLNFDEHGVITNAVDCSSSFLSEIQCKTQSFAPNTGVYDLSGFTVKPVATVYRRIPNLPDCDIDNWLNNVSVPSPLNWERRIFSNCNFNLSTLLRLVHVDSFSCNNLDKSKIFGSCFNSITVDKFAIPNRRRDDLQLGSSGFLQSSNYKIDISSSSCQLYYSLPLVNVTINNFNPSSWNRRYGFGSFNLSSYDVVYSDHCFSVNSDFCPCADPSVVNSCAKSKPPSAICPAGTKYRHCDLDTTLYVKNWCRCSCLPDPISTYSPNTCPQKKVVVGIGEHCPGLGINEEKCGTQLNHSSCFCSPDAFLGWSFDSCISNNRCNIFSNFIFNGINSGTTCSNDLLYSNTEISTGVCVNYDLYGITGQGIFKEVSAAYYNNWQNLLYDSNGNIIGFKDFLTNKTYTILPCYSGRVSAAFYQNSSSPALLYRNLKCSYVLNNISFISQPFYFDSYLGCVLNAVNLTSYSVSSCDLRMGSGFCIDYALPSSRRKRRGISSPYRFVTFEPFNVSFVNDSVETVGGLFEIQIPTNFTIAGHEEFIQTSSPKVTIDCSAFVCSNYAACHDLLSEYGTFCDNINSILNEVNDLLDITQLQVANALMQGVTLSSNLNTNLHSDVDNIDFKSLLGCLGSQCGSSSRSLLEDLLFNKVKLSDVGFVEAYNNCTGGSEIRDLLCVQSFNGIKVLPPILSETQISGYTTAATVAAMFPPWSAAAGVPFSLNVQYRINGLGVTMDVLNKNQKLIANAFNKALLSIQNGFTATNSALAKIQSVVNANAQALNSLLQQLFNKFGAISSSLQEILSRLDNLEAQVQIDRLINGRLTALNAYVSQQLSDITLIKAGASRAIEKVNECVKSQSPRINFCGNGNHILSLVQNAPYGLLFIHFSYKPTSFKTVLVSPGLCLSGDRGIAPKQGYFIKQNDSWMFTGSSYYYPEPISDKNVVFMNSCSVNFTKAPFIYLNNSIPNLSDFEAELSLWFKNHTSIAPNLTFNSHINATFLDLYYEMNVIQESIKSLNSSFINLKEIGTYEMYVKWPWYIWLLIVILFIIFLMILFFICCCTGCGSACFSKCHNCCDEYGGHNDFVIKASHDD

SEQ ID NO: 2948 - DNA, 4071 bp, Corononavirus-HKU1
  CDS (1)..(4071)
atgttattaattatttttattttgcctacaacattagctgttataggtgattttaattgtactaattttgctattaatgatttaaacaccacagttcctcgcataagtgagtatgttgtggatgtttcttatggtttgggtacatattatatacttgatcgtgtttatttaaatactactatattatttactggttatttccctaaatctggtgccaattttagggatctatctttaaaaggtactacatatttgagtactctttggtatcagaaaccctttttatctgattttaataatggtattttttctagagttaagaatactaagttgtatgttaataaaactttgtatagtgagtttagtactatagttataggtagtgtttttattaacaactcttatactattgttgttcaacctcataatggtgttttggagattacagcttgtcaatacactatgtgtgagtatcctcatactatttgtaaatctaaaggtagttctcgtaatgaatcttggcattttgataaatctgaacctttgtgtctgttcaagaaaaattttacttataatgtttctacagattggttgtattttcatttttatcaagaacgtggcactttttatgcttattatgctgattctggcatgcctactacttttttatttagtttgtatcttggtactcttttatctcattattatgttttgcctttgacttgtaatgctatatcttctaatactgataatgagactttacaatattgggtcacacctttgtctaaacgccaatatcttcttaaatttgacaaccgtggtgttattactaatgctgttgattgttctagtagtttctttagcgagattcaatgtaaaactaaatctttattacctaatactggtgtttatgacttatctggttttactgttaagcctgttgcaactgtacatcgtcgtattcctgatttacctgattgtgacattgataaatggcttaacaattttaatgtaccctcacctcttaattgggaacgtaaaattttttctaattgcaactttaatttgagtactttgcttcgtttagttcatactgattctttttcttgtaataattttgatgaatctaagatatatggtagttgttttaagagtattgttttagataaatttgccatacccaactccagacgatctgatttgcagttgggcagttctggttttctgcaatcttctaattataaaattgacactacttctagttcttgtcaattgtattatagtttgcctgcaattaatgttactattaataattataatccttcttcttggaatagaaggtatggttttaataattttaatttgagctctcatagtgttgtttactcacgttattgtttttctgttaataatactttttgtccttgtgctaaaccttcttttgcttcaagttgcaagagtcataaaccaccttctgcttcctgtcctattggtactaattatcgttcttgtgagagtactactgtactcgaccacactgactggtgtaggtgttcttgtttacctgatcctataactgcttatgaccctaggtcttgttctcaaaaaaagtctctggtcggtgttggtgaacattgtgcagggttcggtgttgatgaagaaaagtgtggtgtattggatggatcatataatgtttcttgtctttgtagtactgatgcctttctaggttggtcttatgacacttgcgtcagtaacaaccgttgtaatattttttctaattttattttaaatggtatcaatagtggtaccacttgttctaatgatttattgcagcctaatactgaagtttttactgatgtttgtgttgattacgacctttatggtattacaggacaaggtatttttaaagaagtttctgctgtttattataatagttggcaaaatcttttgtatgattctaatggcaacattattggttttaaagattttgttactaataaaacatataatattttcccttgttatgcaggaagagtttctgctgcttttcatcaaaatgcttcctctttggctttactttatcgtaatttaaaatgtagctatgttttgaataatatttctttagctactcagccatattttgatagttatcttggttgcgtttttaatgctgataatttaactgattattctgtttcttcttgtgctcttcgcatgggtagtggtttttgtgttgattataactcaccttcttcttcctcttcgcgtcgtaaacgtagaagtatttctgcttcttatcgttttgttacttttgaaccctttaatgtcagttttgttaatgacagtattgagtctgtgggtggtctttatgagatcaaaattcccactaactttactatagttggtcaagaggaatttattcaaactaattctcctaaagttactattgattgttctttatttgtctgttctaattatgcagcttgccatgacttattgtcagagtatggcactttttgtgataatattaatagtattttagatgaagttaatggtttacttgatactactcaattgcatgtagctgatactcttatgcaaggtgtcacacttagctccaatcttaatactaatttgcattttgatgttgataatattaattttaaatccctagttggatgtttaggtccacactgcggttcttcttctcgttctttttttgaagatttattgtttgacaaagttaaactttcagatgttggttttgttgaagcttataacaattgtactggtggtagtgaaattagagatcttctttgtgtacaatcctttaatggtattaaagttttgcctcctattttgtctgaatctcaaatttctggttacaccacagccgctactgttgctgctatgtttccaccatggtcagcagcagctggcataccattttctcttaatgtacaatatagaattaatggtttgggtgttactatggatgttcttaataaaaatcaaaagttgatagctactgcttttaataatgctcttctttctattcagaatggttttagtgctaccaactctgcacttgctaaaatacaaagtgttgttaattctaatgctcaagcacttaatagtttgttacagcaattatttaataaatttggtgcaattagttcttctttacaagaaattttatctcgtctcgatgctttagaggctcaggttcagattgataggcttattaatggtcgtttaactgctttaaatgcttatgtctctcaacagcttagtgatatttctcttgtaaaatttggtgctgctttagctatggagaaggttaatgagtgtgttaaaagtcaatctcctcgtattaatttttgtggtaatggtaatcatattttgtcattagttcaaaatgctccttatggtttgttgtttatgcattttagttataaacctatttcttttaaaactgttttagtaagtcctggtttgtgtatatcaggtgatgtaggtattgcacctaaacaagggtattttattaaacataatgatcattggatgttcactggtagttcttactattatcctgaaccaatttcagataaaaatgttgtttttatgaatacttgttctgttaattttactaaagcgcctcttgtttatttgaatcattctgtaccaaaattgtctgattttgaatctgagttatctcattggtttaaaaatcaaacatccattgcgcctaatttgactttaaatcttcatactattaatgctacttttttagatttgtattatgagatgaatcttattcaagagtctattaagtctttgaataatagttatatcaatcttaaagatataggtacatatgaaatgtatgtaaaatggccttggtatgtttggctactaatttctttttcatttataatattccttgtattgctcttttttatatgttgttgtactggttgtggttctgcatgttttagtaaatgtcataattgttgtgatgagtatggtggtcatcatgattttgttatcaaaacatctcatgatgattag

SEQ ID NO: 2949 - protein, 1356 aa, Corononavirus-HKU1; identical to SEQ ID NO: 2941

SEQ ID NO: 2950 - DNA, 4071 bp, Corononavirus-HKU1
  CDS (1)..(4071)
atgttattaattatttttattttgcctacaacattagctgttataggtgattttaattgtactaattttgctattaatgatttaaacaccacagttcctcgcataagtgagtatgttgtggatgtttcttatggtttgggtacatattatatacttgatcgtgtttatttaaatactactatattatttactggttatttccctaaatctggtgccaattttagggatctatctttaaaaggtactacatatttgagtactctttggtatcagaaaccctttttatctgattttaataatggtattttttctagagttaagaatactaagttgtatgttaataaaactttgtatagtgagtttagtactatagttataggtagtgtttttattaacaactcttatactattgttgttcaacctcataatggtgttttggagattacagcttgtcaatacactatgtgtgagtatcctcatactatttgtaaatctaaaggtagttctcgtaatgaatcttggcattttgataaatctgaacctttgtgtctgttcaagaaaaattttacttataatgtttctacagattggttgtattttcatttttatcaagaacgtggcactttttatgcttattatgctgattctggcatgcctactacttttttatttagtttgtatcttggtactcttttatctcattattatgttttgcctttgacttgtaatgctatatcttctaatactgataatgagactttacaatattgggtcacacctttgtctaaacgccaatatcttcttaaatttgacaaccgtggtgttattactaatgctgttgattgttctagtagtttctttagcgagattcaatgtaaaactaaatctttattacctaatactggtgtttatgacttatctggttttactgttaagcctgttgcaactgtacatcgtcgtattcctgatttacctgattgtgacattgataaatggcttaacaattttaatgtaccctcacctcttaattgggaacgtaaaattttttctaattgcaactttaatttgagtactttgcttcgtttagttcatactgattctttttcttgtaataattttgatgaatctaagatatatggtagttgttttaagagtattgttttagataaatttgccatacccaactccagacgatctgatttgcagttgggcagttctggttttctgcaatcttctaattataaaattgacactacttctagttcttgtcaattgtattatagtttgcctgcaattaatgttactattaataattataatccttcttcttggaatagaaggtatggttttaataattttaatttgagctctcatagtgttgtttactcacgttattgtttttctgttaataatactttttgtccttgtgctaaaccttcttttgcttcaagttgcaagagtcataaaccaccttctgcttcctgtcctattggtactaattatcgttcttgtgagagtactactgtactcgaccacactgactggtgtaggtgttcttgtttacctgatcctataactgcttatgaccctaggtcttgttctcaaaaaaagtctctggttggtgttggtgaacattgtgcagggttcggtgttgatgaagaaaagtgtggtgtattggatggatcatataatgtttcttgtctttgtagtactgatgcctttctaggttggtcttatgacacttgcgtcagtaacaaccgttgtaatattttttctaattttattttaaatggtatcaatagtggtaccacttgttctaatgatttattgcagcctaatactgaagtttttactgatgtttgtgttgattacgacctttatggtattacaggacaaggtatttttaaagaagtttctgctgtttattataatagttggcaaaatcttttgtatgattctaatggcaacattattggttttaaagattttgttactaataaaacatataatattttcccttgttatgcaggaagagtttctgctgcttttcatcaaaatgcttcctctttggctttactttatcgtaatttaaaatgtagctatgttttgaataatatttctttagctactcagccatattttgatagttatcttggttgcgtttttaatgctgataatttaactgattattctgtttcttcttgtgctcttcgcatgggtagtggtttttgtgttgattataactcaccttcttcttcctcttcgcgtcgtaaacgtagaagtatttctgcttcttatcgttttgttacttttgaaccctttaatgtcagttttgttaatgacagtattgagtctgtgggtggtctttatgagatcaaaattcccactaactttactatagttggtcaagaggaatttattcaaactaattctcctaaagttactattgattgttctttatttgtctgttctaattatgcagcttgccatgacttattgtcagagtatggcactttttgtgataatattaatagtattttagatgaagttaatggtttacttgatactactcaattgcatgtagctgatactcttatgcaaggtgtcacacttagctccaatcttaatactaatttgcattttgatgttgataatattaattttaaatccctagttggatgtttaggtccacactgcggttcttcttctcgttctttttttgaagatttattgtttgacaaagttaaactttcagatgttggttttgttgaagcttataacaattgtactggtggtagtgaaattagagatcttctttgtgtacaatcctttaatggtattaaagttttgcctcctattttgtctgaatctcaaatttctggttacaccacagccgctactgttgctgctatgtttccaccatggtcagcagcagctggcataccattttctcttaatgtacaatatagaattaatggtttgggtgttactatggatgttcttaataaaaatcaaaagttgatagctactgcttttaataatgctcttctttctattcagaatggttttagtgctaccaactctgcacttgctaaaatacaaagtgttgttaattctaatgctcaagcacttaatagtttgttacagcaattatttaataaatttggtgcaattagttcttctttacaagaaattttatctcgtctcgatgctttagaggctcaggttcagattgataggcttattaatggtcgtttaactgctttaaatgcttatgtctctcaacagcttagtgatatttctcttgtaaaatttggtgctgctttagctatggagaaggttaatgagtgtgttaaaagtcaatctcctcgtattaatttttgtggtaatggtaatcatattttgtcattagttcaaaatgctccttatggtttgttgtttatgcattttagttataaacctatttcttttaaaactgttttagtaagtcctggtttgtgtatatcaggtgatgtaggtattgcacctaaacaagggtattttattaaacataatgatcattggatgttcactggtagttcttactattatcctgaaccaatttcagataaaaatgttgtttttatgaatacttgttctgttaattttactaaagcgcctcttgtttatttgaatcattctgtaccaaaattgtctgattttgaatctgagttatctcattggtttaaaaatcaaacatccattgcgcctaatttgactttaaatcttcatactattaatgctacttttttagatttgtattatgagatgaatcttattcaagagtctattaagtctttgaataatagttatatcaatcttaaagatataggtacatatgaaatgtatgtaaaatggccttggtatgtttggctactaatttctttttcatttataatattccttgtattgctcttttttatatgttgttgtactggttgtggttctgcatgttttagtaaatgtcataattgttgtgatgagtatggtggtcatcatgattttgttatcaaaacatctcatgatgattag

SEQ ID NO: 2951 - protein, 1356 aa, Corononavirus-HKU1; identical to SEQ ID NO: 2941

SEQ ID NO: 2952 - DNA, 1326 bp, Corononavirus-HKU1
  CDS (1)..(1326)
atgtcttatactcccggtcatcatgctggaagtagaagctcctctggaaatcgttcaggaatcctcaagaaaacttcttgggttgaccaatctgagcgaagccatcaaacctataatagaggcagaaaaccccaacccaaattcactgtgtctactcaaccacaaggaaaccctatcccacattattcctggttctctgggattacccaatttcaaaaaggtagagactttaaatttccagatggtcaaggagtacccattgcttacgggatacccccttctgaagcaaaaggatattggtataaacacaaccggcgttcttttaaaacagctgatggtcaacaaaagcagttgttaccaagatggtatttctactatctcggtaccggtccatatgccagttcatcctatggtgatgcccacgaaggtatcttctgggtcgctagtcaccaagctgacacttctattccctccgatgtttcggcaagggatcctactattcaagaagctatccctactaggttttcgcctggtacgattttgcctcaaggctattatgttgaaggctcaggaaggtctgcttctaatagccggccaggttcacgttctcaatcacgtggacccaataatcgttcattaagtagaagtaattctaattttagacattctgattctatagtgaaacctgatatggctgatgagattgctagtcttgtcttggccaagcttggtaaagattctaaacctcagcaagttaccaagcaaaatgctaaggaaattaggcataaaattttaatgaaacctcgccaaaagcgaactcctaataaattttgtaatgttcaacagtgttttggtaaaagaggaccgctccaaaactttggtaattctgaaatgttaaagcttggtactaatgatcctcaatttcctattcttgctgaattagcccctacaccaggtgcttttttctttggctctaaattagagttgtttaaaagagactctgatgctgattcaccttctaaagacacttttgaacttcgttattctggttctattaggtttgatagtactttacctggttttgagacaattatgaaagttcttaaagagaatttagatgcttatgttaattctaatcagaacactgtttctggttcgctgagtcctaaacctcagcgtaaaagaggtgttaaacaatcacctgaatcgtttgactctcttaatttaagtgctgatactcagcacatttcaaatgattttactcctgaggatcatagtttacttgctactcttgatgatycttatgtagaagactctgttgcttaa

SEQ ID NO: 2953 - protein, 441 aa, Corononavirus-HKU1
  MOD_RES (434): Pro or Ser
MSYTPGHHAGSRSSSGNRSGILKKTSWVDQSERSHQTYNRGRKPQPKFTVSTQPQGNPIPHYSWFSGITQFQKGRDFKFPDGQGVPIAYGIPPSEAKGYWYKHNRRSFKTADGQQKQLLPRWYFYYLGTGPYASSSYGDAHEGIFWVASHQADTSIPSDVSARDPTIQEAIPTRFSPGTILPQGYYVEGSGRSASNSRPGSRSQSRGPNNRSLSRSNSNFRHSDSIVKPDMADEIASLVLAKLGKDSKPQQVTKQNAKEIRHKILMKPRQKRTPNKFCNVQQCFGKRGPLQNFGNSEMLKLGTNDPQFPILAELAPTPGAFFFGSKLELFKRDSDADSPSKDTFELRYSGSIRFDSTLPGFETIMKVLKENLDAYVNSNQNTVSGSLSPKPQRKRGVKQSPESFDSLNLSADTQHISNDFTPEDHSLLATLDDXYVEDSVA

SEQ ID NO: 2954 - DNA, 1326 bp, Corononavirus-HKU1
  CDS (1)..(1326)
atgtcttatactcccggtcattatgctggaagtagaagctcctctggaaatcgttcaggaatcctcaagaaaacttcttgggctgaccaatctgagcgaaattaccaaacctttaatagaggcagaaaaacccaacctaaattcactgtgtctactcaaccacaaggaaatactatcccacattattcctggttctccgggatcactcaatttcaaaaaggtagagactttaaattttcagatggtcaaggagttcccattgctttcggagtacccccttctgaagcaaaaggatattggtatagacacagccggcgttcttttaaaacagctgatggtcaacaaaagcagttgttaccgagatggtatttctactatctcggtaccggcccatatgccaatgcatcctatggtgaatccctcgaaggggtcttctgggttgctaatcaccaagctgacacttctactccctccgatgtttcgtcaagggatcctactactcaagaagctatccctactaggtttccgcctggtacgattttgcctcaaggctattatgttgaaggctcaggaaggtctgcttctaatagtcgaccaggttcacgttctcaatcacgtggacccaataatcgttcattaagtagaagtaattctaattttagacattcagattctatagtaaaacctgatatggctgatgagatcgctaatcttgttttagccaagcttggtaaagattctaaacctcagcaagtcactaagcaaaatgccaaggaaatcaggcataaaattttaacaaaacctcgccaaaagcgaactcctaataaacattgtaatgttcaacagtgttttggtaaaagaggaccttctcaaaattttggtaatgctgaaatgttaaagcttggtactaatgatcctcagtttcctattcttgcagaattagctcctacaccaggtgcttttttctttggttctaaattagacttggttaaaagagattccgaggctgactcacctgttaaagatgtttttgaacttcattattctggttctattaggtttgatagtactttaccaggctttgagacaattatgaaagttcttgaagagaatttaaatgcttacgttaattctaatcagaacactgattctgattcgttgagttctaaacctcagcgtaaaagaggtgttaaacaattaccagaacagtttgactctcttaatttaagtgctggtactcagcacatttcaaatgattttactcctgaggatcatagtttacttgctactcttgatgatccttatgtagaagactctgttgcttaa

SEQ ID NO: 2955 - protein, 441 aa, Corononavirus-HKU1
MSYTPGHYAGSRSSSGNRSGILKKTSWADQSERNYQTFNRGRKTQPKFTVSTQPQGNTIPHYSWFSGITQFQKGRDFKFSDGQGVPIAFGVPPSEAKGYWYRHSRRSFKTADGQQKQLLPRWYFYYLGTGPYANASYGESLEGVFWVANHQADTSTPSDVSSRDPTTQEAIPTRFPPGTILPQGYYVEGSGRSASNSRPGSRSQSRGPNNRSLSRSNSNFRHSDSIVKPDMADEIANLVLAKLGKDSKPQQVTKQNAKEIRHKILTKPRQKRTPNKHCNVQQCFGKRGPSQNFGNAEMLKLGTNDPQFPILAELAPTPGAFFFGSKLDLVKRDSEADSPVKDVFELHYSGSIRFDSTLPGFETIMKVLEENLNAYVNSNQNTDSDSLSSKPQRKRGVKQLPEQFDSLNLSAGTQHISNDFTPEDHSLLATLDDPYVEDSVA

SEQ ID NO: 2956 - DNA, 1326 bp, Corononavirus-HKU1
  CDS (1)..(1326)
atgtcttatactcccggtcattatgctggaagtagaagctcctctggaaatcgttcaggaatcctcaagaaaacttcttgggctgaccaatctgaacgaaattaccaaacctttaatagaggcagaaaaacccaacctaaattcactgtgtctactcaaccacaaggaaatactatcccacattattcctggttctccgggatcactcaatttcaaaaaggtagagactttaaattttcagatggtcaaggagttcccattgctttcggagtacccccttctgaagcaaaaggatattggtatagacacagccggcgttcttttaaaacagctgatggtcaacaaaagcagttgttaccgagatggtatttctactatctcggtaccggcccatatgccaatgcatcctatggtgaatccctcgaaggggtcttctgggttgctaatcaccaagctgacacttctactccctccgatgtttcgtcaagggatcctactactcaagaagctatccctactaggtttccgcctggtacgattttgcctcaaggctattatgttgaaggctcaggaaggtctgcttctaatagtcgaccaggttcacgttctcaatcacgtggacccaataatcgttcattaagtagaagtaattctaattttagacattcagattctatagtaaaacctgatatggctgatgagattgctaatcttgttttagccaagcttggtaaagaatctaaacctcagcaagtcactaagcaaaatgccaaggaaattaggcataaaattttaacaaaacctcgccaaaagcgaactcctaataaacattgtaatgttcaacagtgttttggtaaaagaggaccttctcaaaattttggtaatgctgaaatgttaaagcttggtactaatgatcctcagtttcctattcttgcagaattagctcctacaccaggtgcttttttctttggttctaaattagacttggttaaaagagattccgaggctgactcacctgttaaagatgtttttgaacttcattattctggttctattaggtttgatagtactttaccaggctttgagacaattatgaaagttcttgaagagaatttaaatgcttatgttaattctaatcagaacactgattctgattcgttgagttctaaacctcagcgtaaaagaggtgttaaacaattaccagaacagtttgactctcttaatttaagtgctggtactcagcacatttcaaatgattttactcctgaggatcatagtttacttgctactcttgacgatccttatgtagaagactctgttgcttaa

SEQ ID NO: 2957 - protein, 441 aa, Corononavirus-HKU1
MSYTPGHYAGSRSSSGNRSGILKKTSWADQSERNYQTFNRGRKTQPKFTVSTQPQGNTIPHYSWFSGITQFQKGRDFKFSDGQGVPIAFGVPPSEAKGYWYRHSRRSFKTADGQQKQLLPRWYFYYLGTGPYANASYGESLEGVFWVANHQADTSTPSDVSSRDPTTQEAIPTRFPPGTILPQGYYVEGSGRSASNSRPGSRSQSRGPNNRSLSRSNSNFRHSDSIVKPDMADEIANLVLAKLGKESKPQQVTKQNAKEIRHKILTKPRQKRTPNKHCNVQQCFGKRGPSQNFGNAEMLKLGTNDPQFPILAELAPTPGAFFFGSKLDLVKRDSEADSPVKDVFELHYSGSIRFDSTLPGFETIMKVLEENLNAYVNSNQNTDSDSLSSKPQRKRGVKQLPEQFDSLNLSAGTQHISNDFTPEDHSLLATLDDPYVEDSVA

SEQ ID NO: 2958 - DNA, 1326 bp, Corononavirus-HKU1; identical to SEQ ID NO: 2956
  CDS (1)..(1326)

SEQ ID NO: 2959 - protein, 441 aa, Corononavirus-HKU1; identical to SEQ ID NO: 2957

SEQ ID NO: 2960 - DNA, 1326 bp, Corononavirus-HKU1; identical to SEQ ID NO: 2956
  CDS (1)..(1326)

SEQ ID NO: 2961 - protein, 441 aa, Corononavirus-HKU1; identical to SEQ ID NO: 2957

SEQ ID NO: 2962 - DNA, 1326 bp, Corononavirus-HKU1
  CDS (1)..(1326)
atgtcttatactcccggtcatcatgctggaagtagaagctcctctggaaatcgttcaggaatcctcaagaaaacttcttgggttgaccaatctgagcgaagccatcaaacctataatagaggcagaaaaccccaaccaaaattcactgtgtctactcaaccacaaggaaaccctatcccacattattcctggttctctgggattacccaatttcaaaaaggtagagactttaaatttccagatggtcaaggagtacccattgcttacgggatacccccttctgaagcaaaaggatattggtataaacacaaccggcgttcttttaaaacagctgatggtcaacaaaagcagttgttaccaagatggtatttctactatctcggtaccggtccatatgccagttcatcctatggtgatgcccacgaaggtatcttctgggtcgctagtcaccaagctgatacttctattccctccgatgtttcggcaagggatcctactattcaagaagctatccctactaggttttcgcctggtacgattttgcctcaaggctattatgttgaaggctcaggaaggtctgcttctaatagccggccaggttcacgttctcaatcacgtggacccaataatcgttcattaagtagaagtaattctaattttagacattctgattctatagtgaaacctgatatggctgatgagattgctagtcttgtcttagccaagcttggtaaagattctaaacctcagcaagttaccaagcaaaatgctaaggaaattaggcataaaattttaatgaaacctcgccaaaagcgaactcctaataaattttgtaatgttcaacagtgttttggtaaaagaggaccgctccaaaactttggtaattctgaaatgttaaagcttggtactaatgatcctcaatttcctattcttgctgaattagctcctacaccaggtgcttttttctttggctctaaattagagttgtttaaaagagactctgatgctgattcaccttctaaagacacttttgaacttcgttattctggttctattaggtttgatagtactttacctggttttgagacaattatgaaagttcttaaagagaatttagatgcttatgttaattctaatcagaacactgtttctggttcgctgagtcctaaacctcagcgtaaaagaggtgttaaacaatcacctgaatcgtttgactctcttaatttaagtgctgatactcagcacatttcaaatgattttactcctgaggatcatagtttacttgctactcttgatgatccttatgtagaagactctgttgcttaa

SEQ ID NO: 2963 - protein, 441 aa, Corononavirus-HKU1
MSYTPGHHAGSRSSSGNRSGILKKTSWVDQSERSHQTYNRGRKPQPKFTVSTQPQGNPIPHYSWFSGITQFQKGRDFKFPDGQGVPIAYGIPPSEAKGYWYKHNRRSFKTADGQQKQLLPRWYFYYLGTGPYASSSYGDAHEGIFWVASHQADTSIPSDVSARDPTIQEAIPTRFSPGTILPQGYYVEGSGRSASNSRPGSRSQSRGPNNRSLSRSNSNFRHSDSIVKPDMADEIASLVLAKLGKDSKPQQVTKQNAKEIRHKILMKPRQKRTPNKFCNVQQCFGKRGPLQNFGNSEMLKLGTNDPQFPILAELAPTPGAFFFGSKLELFKRDSDADSPSKDTFELRYSGSIRFDSTLPGFETIMKVLKENLDAYVNSNQNTVSGSLSPKPQRKRGVKQSPESFDSLNLSADTQHISNDFTPEDHSLLATLDDPYVEDSVA

SEQ ID NO: 2964 - DNA, 1326 bp, Corononavirus-HKU1
  CDS (1)..(1326)
atgtcttatactcccggtcattatgctggaagtagaagctcctctggaaatcgttcaggaatcctcaagaaaacttcttgggctgaccaatctgaacgaaattaccaaacctttaatagaggcagaaaaacccaacctaaattcactgtgtctactcaaccacaaggaaatactatcccacattattcctggttctccgggatcactcaatttcaaaaaggtagagactttaaattttcagatggtcaaggagttcccattgctttcggagtacccccttctgaagcaaaaggatattggtatagacacaaccggcgttcttttaaaacagctgatggtcaacaaaagcagttgttaccgagatggtatttctactatctcggtaccggcccatatgccaatgcatcctatggtgaatccctcgaaggggtcttctgggttgctaatcaccaagctgacacttctactccctccgatgtttcgtcaagggatcctactactcaagaagctatccctactaggtttccgcctggtacgattttgcctcaaggctattatgttgaaggctcaggaaggtctgcttctaatagtcgaccaggttcacgttctcaatcacgtggacccaataatcgttcattaagtagaagtaattccaattttagacattcagattctatagtaaaacctgatatggctgatgagattgctaatcttgttttagccaagcttggtaaagaatctaaacctcagcaagtcactaagcaaaatgccaaggaaattaggcataaaattttaacaaaacctcgccaaaagcgaactcctaataaacattgtaatgttcaacagtgttttggtaaaagaggaccttctcaaaattttggtaatgctgaaatgttaaagcttggtactaatgatcctcagtttcctattcttgcagaattagctcctacaccaggtgcttttttctttggttctaaattagacttggttaaaagagattccgaggctgactcacctgttaaagatgtttttgaacttcattattctggttctattaggtttgatagtactttaccaggctttgagacaattatgaaagttcttgaagagaacttaaatgcttatgttaattctaatcagaacactgattctgattcgttgagttctaaacctcagcgtaaaagaggtgttaaacaattaccagaacagtttgactctcttaatttaagtgctggtactcagcacatttcaaatgattttactcctgaggatcatagtttacttgctactcttgacgatccttatgtagaagactctgttgcttaa

SEQ ID NO: 2965 - protein, 441 aa, Corononavirus-HKU1
MSYTPGHYAGSRSSSGNRSGILKKTSWADQSERNYQTFNRGRKTQPKFTVSTQPQGNTIPHYSWFSGITQFQKGRDFKFSDGQGVPIAFGVPPSEAKGYWYRHNRRSFKTADGQQKQLLPRWYFYYLGTGPYANASYGESLEGVFWVANHQADTSTPSDVSSRDPTTQEAIPTRFPPGTILPQGYYVEGSGRSASNSRPGSRSQSRGPNNRSLSRSNSNFRHSDSIVKPDMADEIANLVLAKLGKESKPQQVTKQNAKEIRHKILTKPRQKRTPNKHCNVQQCFGKRGPSQNFGNAEMLKLGTNDPQFPILAELAPTPGAFFFGSKLDLVKRDSEADSPVKDVFELHYSGSIRFDSTLPGFETIMKVLEENLNAYVNSNQNTDSDSLSSKPQRKRGVKQLPEQFDSLNLSAGTQHISNDFTPEDHSLLATLDDPYVEDSVA

SEQ ID NO: 2966 - DNA, 1326 bp, Corononavirus-HKU1
  CDS (1)..(1326)
atgtcttatactcccggtcattatgctggaagtagaagctcctctggaaatcgttcaggaatcctcaagaaaacttcttgggctgaccaatctgaacgaaattaccaaacctttaatagaggcagaaaaacccaacctaaattcactgtgtctactcaaccacaaggaaatactatcccacattattcctggttctccgggatcactcaatttcaaaaaggtagagactttaaattttcagatggtcaaggagttcccattgctttcggagtacccccttctgaagcaaaaggatattggtatagacacagccggcgttcttttaaaacagctgatggtcaacaaaagcagttgttaccgagatggtatttctactatctcggtaccggcccatatgccaatgcatcctatggtgaatccctcgaaggggtcttctgggttgctaatcaccaagctgacacttctactccctccgatgtttcgtcaagggatcctactactcaagaagctatccctactaggtttccgcctggtacgattttgcctcaaggctattatgttgaaggctcaggaaggtctgcttctaatagtcgaccaggttcacgttctcaatcacgtggacccaataatcgttcattaagtagaagtaattctaattttagacattcagattctatagtaaaacctgatatggctgatgagattgctaatcttgttttagccaagcttggtaaagaatctaaacctcagcaagtcactaagcaaaatgccaaggaaattaggcataaaattttaacaaaacctcgccaaaagcgaactcctaataaacattgtaatgttcaacagtgttttggtaaaagaggaccttctcaaaattttggtaatgctgaaatgttaaagcttggtactaatgatcctcagtttcctattcttgcagaattagctcctacaccaggtgcttttttctttggttctaaattagacttggttaaaagagattccgaggctgactcacctgttaaagatgtttttgaacttcattattctggttctattaggtttgatagtactttaccaggctttgagacaattatgaaagttcttgaagagaacttaaatgcttatgttaattctaatcagaacactgattctgattcgttgagttctaaacctcagcgtaaaagaggtgttaaacaattaccagaacagtttgactctcttaatttaagtgctggtactcagcacatttcaaatgattttactcctgaggatcatagtttacttgctactcttgacgatccttatgtagaagactctgttgcttaa

SEQ ID NO: 2967 - protein, 441 aa, Corononavirus-HKU1; identical to SEQ ID NO: 2957

SEQ ID NO: 2968 - DNA, 22 bp, Corononavirus-HKU1
aaaggatgttgacaaccctgtt

SEQ ID NO: 2969 - DNA, 23 bp, Corononavirus-HKU1
atcatcatactaaaatgcttaca

SEQ ID NO: 2970 - DNA, 29836 bp, Corononavirus-HKU1; identical to SEQ ID NO: 2919
  CDS (1)..(29835)
  modified_base (29514): a, c, g, t, unknown or other

SEQ ID NO: 2971 - protein, 18 aa, Corononavirus-HKU1
ERIASVPSISLRSLVRSH

SEQ ID NO: 2972 - protein, 44 aa, Corononavirus-HKU1; identical to SEQ ID NO: 36

SEQ ID NO: 2973 - protein, 26 aa, Corononavirus-HKU1
NQQIRSRLQVGARISLAASGCSGGVG

SEQ ID NO: 2974 - protein, 5 aa, Corononavirus-HKU1
SYEVR

SEQ ID NO: 2975 - protein, 18 aa, Corononavirus-HKU1
GWVMPLYWSSDGKCWICL

SEQ ID NO: 2976 - protein, 22 aa, Corononavirus-HKU1
SCEDRLSLHSWTRMACAVKSYP

SEQ ID NO: 2977 - protein, 4 aa, Corononavirus-HKU1
YFCS

SEQ ID NO: 2978 - protein, 9 aa, Corononavirus-HKU1
RSTCCRSSN

SEQ ID NO: 2979 - protein, 11 aa, Corononavirus-HKU1
NSRKVRYGNFN

SEQ ID NO: 2980 - protein, 4 aa, Corononavirus-HKU1
ITFA

SEQ ID NO: 2981 - protein, 5 aa, Corononavirus-HKU1
LGWFS

SEQ ID NO: 2982 - protein, 12 aa, Corononavirus-HKU1
RVCYGLVPFIQD

SEQ ID NO: 2983 - protein, 14 aa, Corononavirus-HKU1
TLCCTSSFYDYIYY

SEQ ID NO: 2984 - protein, 23 aa, Corononavirus-HKU1
RFFGLDCTFWFYAILCSQMVSIL

SEQ ID NO: 2985 - protein, 6 aa, Corononavirus-HKU1
FNNFKF

SEQ ID NO: 2986 - protein, 6 aa, Corononavirus-HKU1
CRRCLC

SEQ ID NO: 2987 - protein, 9 aa, Corononavirus-HKU1
IFTKSLCFT

SEQ ID NO: 2988 - protein, 5 aa, Corononavirus-HKU1
TISWY

SEQ ID NO: 2989 - protein, 10 aa, Corononavirus-HKU1
TRTLCRPVWL

SEQ ID NO: 2990 - protein, 29 aa, Corononavirus-HKU1
ISRLSSSLWSLFFARYETKAVCMACQLRL

SEQ ID NO: 2991 - protein, 9 aa, Corononavirus-HKU1
YCSGLACSS

SEQ ID NO: 2992 - protein, 16 aa, Corononavirus-HKU1
FTICYAPADYSYYLWY

SEQ ID NO: 2993 - protein, 17 aa, Corononavirus-HKU1
ICCTTYRRCSRWSCSYT

SEQ ID NO: 2994 - protein, 7 aa, Corononavirus-HKU1
TCTFIIC

SEQ ID NO: 2995 - protein, 7 aa, Corononavirus-HKU1
CNSFKAS

SEQ ID NO: 2996 - protein, 9 aa, Corononavirus-HKU1
FDESYDSYG

SEQ ID NO: 2997 - protein, 5 aa, Corononavirus-HKU1
IYIQC

SEQ ID NO: 2998 - protein, 13 aa, Corononavirus-HKU1
LWFCYAVWLCRLF

SEQ ID NO: 2999 - protein, 7 aa, Corononavirus-HKU1
FLWLGFR

SEQ ID NO: 3000 - protein, 14 aa, Corononavirus-HKU1
YDGWFFLSIVLYSL

SEQ ID NO: 3001 - protein, 8 aa, Corononavirus-HKU1
SPIIWCYS

SEQ ID NO: 3002 - protein, 6 aa, Corononavirus-HKU1
ESCVIY

SEQ ID NO: 3003 - protein, 26 aa, Corononavirus-HKU1
FVWLFCYTIWFLYILVTASWIVDSYH

SEQ ID NO: 3004 - protein, 6 aa, Corononavirus-HKU1
IFSQVL

SEQ ID NO: 3005 - protein, 9 aa, Corononavirus-HKU1
FGLFRCSRL

SEQ ID NO: 3006 - protein, 16 aa, Corononavirus-HKU1
RNCSYYSCTLLRLCSM

SEQ ID NO: 3007 - protein, 7 aa, Corononavirus-HKU1
TKSYSWC

SEQ ID NO: 3008 - protein, 4 aa, Corononavirus-HKU1
ATVA

SEQ ID NO: 3009 - protein, 6 aa, Corononavirus-HKU1
YAFKKY

SEQ ID NO: 3010 - protein, 23 aa, Corononavirus-HKU1
FCLQVCSLWRWFCTFFTRWFNSP

SEQ ID NO: 3011 - protein, 22 aa, Corononavirus-HKU1
LLSNSEWYFLYIFDVSIFTRSF

SEQ ID NO: 3012 - protein, 24 aa, Corononavirus-HKU1
YVFKNVYFVYGQSFSCYILYRALC

SEQ ID NO: 3013 - protein, 5 aa, Corononavirus-HKU1
VGYSI

SEQ ID NO: 3014 - protein, 7 aa, Corononavirus-HKU1
VIGYYTC

SEQ ID NO: 3015 - protein, 5 aa, Corononavirus-HKU1
YHVRC

SEQ ID NO: 3016 - protein, 23 aa, Corononavirus-HKU1
CTCYRLASLPIIEWSFCSISSQL

SEQ ID NO: 3017 - protein, 6 aa, Corononavirus-HKU1
FCCFNT

SEQ ID NO: 3018 - protein, 5 aa, Corononavirus-HKU1
ILHFF

SEQ ID NO: 3019 - protein, 8 aa, Corononavirus-HKU1
VIIRVCYS

SEQ ID NO: 3020 - protein, 8 aa, Corononavirus-HKU1
CFKRYACS

SEQ ID NO: 3021 - protein, 8 aa, Corononavirus-HKU1
WFSLYCRQ

SEQ ID NO: 3022 - protein, 11 aa, Corononavirus-HKU1
YRVNSWFCFTM

SEQ ID NO: 3023 - protein, 9 aa, Corononavirus-HKU1
CTGTTNLFF

SEQ ID NO: 3024 - protein, 10 aa, Corononavirus-HKU1
RRCRICYSRR

SEQ ID NO: 3025 - protein, 9 aa, Corononavirus-HKU1
ECQIFFIIL

SEQ ID NO: 3026 - protein, 5 aa, Corononavirus-HKU1
VLSTT

SEQ ID NO: 3027 - protein, 9 aa, Corononavirus-HKU1
ICRKNLYYR

SEQ ID NO: 3028 - protein, 4 aa, Corononavirus-HKU1
YVHG

SEQ ID NO: 3029 - protein, 7 aa, Corononavirus-HKU1
IFPYCHE

SEQ ID NO: 3030 - protein, 15 aa, Corononavirus-HKU1
KYLSFRSGLAFSMCR

SEQ ID NO: 3031 - protein, 14 aa, Corononavirus-HKU1
RETCCYGDSVFDDS

SEQ ID NO: 3032 - protein, 5 aa, Corononavirus-HKU1
FRFYF

SEQ ID NO: 3033 - protein, 5 aa, Corononavirus-HKU1
SLFRI

SEQ ID NO: 3034 - protein, 8 aa, Corononavirus-HKU1
SRKGCYCR

SEQ ID NO: 3035 - protein, 6 aa, Corononavirus-HKU1
FCRCCL

SEQ ID NO: 3036 - protein, 9 aa, Corononavirus-HKU1
CYRECFKLL

SEQ ID NO: 3037 - protein, 14 aa, Corononavirus-HKU1
RSSSGWLSSSCIFK

SEQ ID NO: 3038 - protein, 6 aa, Corononavirus-HKU1
ERCLFI

SEQ ID NO: 3039 - protein, 12 aa, Corononavirus-HKU1
SNGLSYVLYFCY

SEQ ID NO: 3040 - protein, 4 aa, Corononavirus-HKU1
RRYQ

SEQ ID NO: 3041 - protein, 5 aa, Corononavirus-HKU1
RCCYW

SEQ ID NO: 3042 - protein, 5 aa, Corononavirus-HKU1
RCCYW

SEQ ID NO: 3043 - protein, 5 aa, Corononavirus-HKU1
RCCYW

SEQ ID NO: 3044 - protein, 5 aa, Corononavirus-HKU1
RCCYW

SEQ ID NO: 3045 - protein, 5 aa, Corononavirus-HKU1
RCCYW

SEQ ID NO: 3046 - protein, 5 aa, Corononavirus-HKU1
RCCYW

SEQ ID NO: 3047 - protein, 5 aa, Corononavirus-HKU1
RCCYW

SEQ ID NO: 3048 - protein, 5 aa, Corononavirus-HKU1
RCCYW

SEQ ID NO: 3049 - protein, 5 aa, Corononavirus-HKU1
RCCYW

SEQ ID NO: 3050 - protein, 5 aa, Corononavirus-HKU1
RCCYW

SEQ ID NO: 3051 - protein, 5 aa, Corononavirus-HKU1
RCCYW

SEQ ID NO: 3052 - protein, 5 aa, Corononavirus-HKU1
RDCYW

SEQ ID NO: 3053 - protein, 6 aa, Corononavirus-HKU1
PNCCYW

SEQ ID NO: 3054 - protein, 5 aa, Corononavirus-HKU1
SSFSF

SEQ ID NO: 3055 - protein, 4 aa, Corononavirus-HKU1
CFVC

SEQ ID NO: 3056 - protein, 5 aa, Corononavirus-HKU1
NRNIF

SEQ ID NO: 3057 - protein, 10 aa, Corononavirus-HKU1
WFMVTYYYTY

SEQ ID NO: 3058 - protein, 15 aa, Corononavirus-HKU1
LLVAFCVTCNAEITF

SEQ ID NO: 3059 - protein, 4 aa, Corononavirus-HKU1
GFSY

SEQ ID NO: 3060 - protein, 6 aa, Corononavirus-HKU1
KYVVIL

SEQ ID NO: 3061 - protein, 4 aa, Corononavirus-HKU1
SKFC

SEQ ID NO: 3062 - protein, 7 aa, Corononavirus-HKU1
LFTDHYS

SEQ ID NO: 3063 - protein, 11 aa, Corononavirus-HKU1
SYCFASRWLCS

SEQ ID NO: 3064 - protein, 9 aa, Corononavirus-HKU1
LCLLVFKPV

SEQ ID NO: 3065 - protein, 10 aa, Corononavirus-HKU1
LVLFKMWFFF

SEQ ID NO: 3066 - protein, 18 aa, Corononavirus-HKU1
FKWFGCCVFLWRYCVSCL

SEQ ID NO: 3067 - protein, 17 aa, Corononavirus-HKU1
YDSNSSGLTLYITFFII

SEQ ID NO: 3068 - protein, 8 aa, Corononavirus-HKU1
QFLCFLHP

SEQ ID NO: 3069 - protein, 21 aa, Corononavirus-HKU1
KNFYCCMCCGCKRLSFCSCYR

SEQ ID NO: 3070 - protein, 4 aa, Corononavirus-HKU1
TNRW

SEQ ID NO: 3071 - protein, 9 aa, Corononavirus-HKU1
FYSRLWNVI

SEQ ID NO: 3072 - protein, 4 aa, Corononavirus-HKU1
YVFF

SEQ ID NO: 3073 - protein, 11 aa, Corononavirus-HKU1
VSSIVWFVYNT

SEQ ID NO: 3074 - protein, 4 aa, Corononavirus-HKU1
CMFC

SEQ ID NO: 3075 - protein, 5 aa, Corononavirus-HKU1
YYKCC

SEQ ID NO: 3076 - protein, 18 aa, Corononavirus-HKU1
WAYAPWWWSCKSYSCSCR

SEQ ID NO: 3077 - protein, 6 aa, Corononavirus-HKU1
RNCCYG

SEQ ID NO: 3078 - protein, 14 aa, Corononavirus-HKU1
RCLPSRRLLCFYRW

SEQ ID NO: 3079 - protein, 4 aa, Corononavirus-HKU1
YCRS

SEQ ID NO: 3080 - protein, 14 aa, Corononavirus-HKU1
TRWKTILCFVSTCL

SEQ ID NO: 3081 - protein, 12 aa, Corononavirus-HKU1
LLFVYSHIGWYI

SEQ ID NO: 3082 - protein, 10 aa, Corononavirus-HKU1
CVINLPSRCC

SEQ ID NO: 3083 - protein, 5 aa, Corononavirus-HKU1
TSYPC

SEQ ID NO: 3084 - protein, 13 aa, Corononavirus-HKU1
YYSKMSNYFSCWY

SEQ ID NO: 3085 - protein, 4 aa, Corononavirus-HKU1
SIGC

SEQ ID NO: 3086 - protein, 5 aa, Corononavirus-HKU1
CRPCY

SEQ ID NO: 3087 - protein, 10 aa, Corononavirus-HKU1
DRCIQTFLEW

SEQ ID NO: 3088 - protein, 17 aa, Corononavirus-HKU1
LFCFKFFCYTRSFIASS

SEQ ID NO: 3089 - protein, 4 aa, Corononavirus-HKU1
YTIE

SEQ ID NO: 3090 - protein, 4 aa, Corononavirus-HKU1
LFVV

SEQ ID NO: 3091 - protein, 9 aa, Corononavirus-HKU1
SSQRLASYQ

SEQ ID NO: 3092 - protein, 5 aa, Corononavirus-HKU1
FYLYM

SEQ ID NO: 3093 - protein, 6 aa, Corononavirus-HKU1
RLWLCM

SEQ ID NO: 3094 - protein, 4 aa, Corononavirus-HKU1
WFFL

SEQ ID NO: 3095 - protein, 7 aa, Corononavirus-HKU1
SSLCVIS

SEQ ID NO: 3096 - protein, 11 aa, Corononavirus-HKU1
EDRCFAYCRWC

SEQ ID NO: 3097 - protein, 7 aa, Corononavirus-HKU1
IYFSYCR

SEQ ID NO: 3098 - protein, 4 aa, Corononavirus-HKU1
FLCR

SEQ ID NO: 3099 - protein, 5 aa, Corononavirus-HKU1
NFISV

SEQ ID NO: 3100 - protein, 5 aa, Corononavirus-HKU1
KFVFS

SEQ ID NO: 3101 - protein, 10 aa, Corononavirus-HKU1
YFCCTKFIWV

SEQ ID NO: 3102 - protein, 8 aa, Corononavirus-HKU1
SATIACLL

SEQ ID NO: 3103 - protein, 5 aa, Corononavirus-HKU1
FFNSM

SEQ ID NO: 3104 - protein, 5 aa, Corononavirus-HKU1
MVCSC

SEQ ID NO: 3105 - protein, 6 aa, Corononavirus-HKU1
RSIFFF

SEQ ID NO: 3106 - protein, 13 aa, Corononavirus-HKU1
LLCECSLSYVAAY

SEQ ID NO: 3107 - protein, 8 aa, Corononavirus-HKU1
MAVAGSMV

SEQ ID NO: 3108 - protein, 7 aa, Corononavirus-HKU1
ISCWQTT

SEQ ID NO: 3109 - protein, 7 aa, Corononavirus-HKU1
VSCSCFS

SEQ ID NO: 3110 - protein, 5 aa, Corononavirus-HKU1
TIRCY

SEQ ID NO: 3111 - protein, 9 aa, Corononavirus-HKU1
FYSCCFETS

SEQ ID NO: 3112 - protein, 6 aa, Corononavirus-HKU1
FIRCNL

SEQ ID NO: 3113 - protein, 5 aa, Corononavirus-HKU1
IRTYL

SEQ ID NO: 3114 - protein, 7 aa, Corononavirus-HKU1
TRKSCWC

SEQ ID NO: 3115 - protein, 11 aa, Corononavirus-HKU1
CCYAFWYISKD

SEQ ID NO: 3116 - protein, 5 aa, Corononavirus-HKU1
NCPLY

SEQ ID NO: 3117 - protein, 9 aa, Corononavirus-HKU1
IECTIFDLF

SEQ ID NO: 3118 - protein, 4 aa, Corononavirus-HKU1
YSSE

SEQ ID NO: 3119 - protein, 4 aa, Corononavirus-HKU1
CCCS

SEQ ID NO: 3120 - protein, 22 aa, Corononavirus-HKU1
HVYGCRCRPLYTFEMWFTLPTL

SEQ ID NO: 3121 - protein, 5 aa, Corononavirus-HKU1
KIYRC

SEQ ID NO: 3122 - protein, 4 aa, Corononavirus-HKU1
WLFN

SEQ ID NO: 3123 - protein, 4 aa, Corononavirus-HKU1
LLVS

SEQ ID NO: 3124 - protein, 11 aa, Corononavirus-HKU1
KFNPDFYIYVD

SEQ ID NO: 3125 - protein, 4 aa, Corononavirus-HKU1
LFFG

SEQ ID NO: 3126 - protein, 4 aa, Corononavirus-HKU1
NGCL

SEQ ID NO: 3127 - protein, 6 aa, Corononavirus-HKU1
SFTILL

SEQ ID NO: 3128 - protein, 11 aa, Corononavirus-HKU1
VLYKTYYKGSV

SEQ ID NO: 3129 - protein, 4 aa, Corononavirus-HKU1
RCLY

SEQ ID NO: 3130 - protein, 4 aa, Corononavirus-HKU1
VSWT

SEQ ID NO: 3131 - protein, 6 aa, Corononavirus-HKU1
YLCSIE

SEQ ID NO: 3132 - protein, 6 aa, Corononavirus-HKU1
CRFAVC

SEQ ID NO: 3133 - protein, 11 aa, Corononavirus-HKU1
VQSNSLACSYW

SEQ ID NO: 3134 - protein, 5 aa, Corononavirus-HKU1
CCFGI

SEQ ID NO: 3135 - protein, 7 aa, Corononavirus-HKU1
ACYLALS

SEQ ID NO: 3136 - protein, 9 aa, Corononavirus-HKU1
SIIEFSYLF

SEQ ID NO: 3137 - protein, 4 aa, Corononavirus-HKU1
CFVC

SEQ ID NO: 3138 - protein, 4 aa, Corononavirus-HKU1
GVTR

SEQ ID NO: 3139 - protein, 10 aa, Corononavirus-HKU1
CGYFCYGIAD

SEQ ID NO: 3140 - protein, 4 aa, Corononavirus-HKU1
VKGC

SEQ ID NO: 3141 - protein, 7 aa, Corononavirus-HKU1
NRRCYYC

SEQ ID NO: 3142 - protein, 5 aa, Corononavirus-HKU1
KFIFS

SEQ ID NO: 3143 - protein, 9 aa, Corononavirus-HKU1
CLGYVFDRL

SEQ ID NO: 3144 - protein, 6 aa, Corononavirus-HKU1
LCCLGC

SEQ ID NO: 3145 - protein, 5 aa, Corononavirus-HKU1
IVTPS

SEQ ID NO: 3146 - protein, 4 aa, Corononavirus-HKU1
ITNS

SEQ ID NO: 3147 - protein, 7 aa, Corononavirus-HKU1
GIYTIWY

SEQ ID NO: 3148 - protein, 13 aa, Corononavirus-HKU1
TYYYTYRFVMFKR

SEQ ID NO: 3149 - protein, 6 aa, Corononavirus-HKU1
SNSFSS

SEQ ID NO: 3150 - protein, 18 aa, Corononavirus-HKU1
SKSYRILWFFEVVVYLCF

SEQ ID NO: 3151 - protein, 6 aa, Corononavirus-HKU1
FITFYK

SEQ ID NO: 3152 - protein, 10 aa, Corononavirus-HKU1
NHFLYYRNSF

SEQ ID NO: 3153 - protein, 6 aa, Corononavirus-HKU1
FVLFGS

SEQ ID NO: 3154 - protein, 6 aa, Corononavirus-HKU1
KCFSDI

SEQ ID NO: 3155 - protein, 19 aa, Corononavirus-HKU1
MEYIYKRFSCCSHCVFVLV

SEQ ID NO: 3156 - protein, 8 aa, Corononavirus-HKU1
FFVYKCYF

SEQ ID NO: 3157 - protein, 4 aa, Corononavirus-HKU1
FLSS

SEQ ID NO: 3158 - protein, 23 aa, Corononavirus-HKU1
CFSYFCGKNCYVDKGYFWFGYNL

SEQ ID NO: 3159 - protein, 10 aa, Corononavirus-HKU1
VRCRFYKSFL

SEQ ID NO: 3160 - protein, 6 aa, Corononavirus-HKU1
IVLFWF

SEQ ID NO: 3161 - protein, 13 aa, Corononavirus-HKU1
YVGYICSYRFCSV

SEQ ID NO: 3162 - protein, 4 aa, Corononavirus-HKU1
TCFI

SEQ ID NO: 3163 - protein, 6 aa, Corononavirus-HKU1
FSQINC

SEQ ID NO: 3164 - protein, 29 aa, Corononavirus-HKU1
TRYWLFIIYSMVLSIILSYWFTIIYYMVA

SEQ ID NO: 3165 - protein, 11 aa, Corononavirus-HKU1
FVYVRNYALVD

SEQ ID NO: 3166 - protein, 6 aa, Corononavirus-HKU1
IYCICS

SEQ ID NO: 3167 - protein, 18 aa, Corononavirus-HKU1
YVTCFCLVAVLYSCYCYV

SEQ ID NO: 3168 - protein, 5 aa, Corononavirus-HKU1
SSWFY

SEQ ID NO: 3169 - protein, 6 aa, Corononavirus-HKU1
AYCLWL

SEQ ID NO: 3170 - protein, 7 aa, Corononavirus-HKU1
SWLFVLL

SEQ ID NO: 3171 - protein, 10 aa, Corononavirus-HKU1
YYCWWCNSLL

SEQ ID NO: 3172 - protein, 7 aa, Corononavirus-HKU1
WWYWFLC

SEQ ID NO: 3173 - protein, 6 aa, Corononavirus-HKU1
TSMELF

SEQ ID NO: 3174 - protein, 4 aa, Corononavirus-HKU1
LPFF

SEQ ID NO: 3175 - protein, 12 aa, Corononavirus-HKU1
HFYNCRSCYRTF

SEQ ID NO: 3176 - protein, 6 aa, Corononavirus-HKU1
TTCKPN

SEQ ID NO: 3177 - protein, 7 aa, Corononavirus-HKU1
CFTLCSY

SEQ ID NO: 3178 - protein, 10 aa, Corononavirus-HKU1
ASWLYDAFVL

SEQ ID NO: 3179 - protein, 7 aa, Corononavirus-HKU1
RWTACLR

SEQ ID NO: 3180 - protein, 5 aa, Corononavirus-HKU1
FICRY

SEQ ID NO: 3181 - protein, 4 aa, Corononavirus-HKU1
SVTF

SEQ ID NO: 3182 - protein, 5 aa, Corononavirus-HKU1
SQSCS

SEQ ID NO: 3183 - protein, 8 aa, Corononavirus-HKU1
FVCSCSRE

SEQ ID NO: 3184 - protein, 13 aa, Corononavirus-HKU1
FSECCCVLCTIIV

SEQ ID NO: 3185 - protein, 14 aa, Corononavirus-HKU1
AYITCRQKVNYYSL

SEQ ID NO: 3186 - protein, 9 aa, Corononavirus-HKU1
WYLCNPDYV

SEQ ID NO: 3187 - protein, 6 aa, Corononavirus-HKU1
YFYVSF

SEQ ID NO: 3188 - protein, 6 aa, Corononavirus-HKU1
HCSCFS

SEQ ID NO: 3189 - protein, 17 aa, Corononavirus-HKU1
RGCAIRKGFRYFCGMCT

SEQ ID NO: 3190 - protein, 4 aa, Corononavirus-HKU1
MLFH

SEQ ID NO: 3191 - protein, 5 aa, Corononavirus-HKU1
NKIYY

SEQ ID NO: 3192 - protein, 13 aa, Corononavirus-HKU1
IYDICSSCWFGIY

SEQ ID NO: 3193 - protein, 9 aa, Corononavirus-HKU1
QFGTYIFKE

SEQ ID NO: 3194 - protein, 14 aa, Corononavirus-HKU1
YCSCRFRCSYTEWC

SEQ ID NO: 3195 - protein, 4 aa, Corononavirus-HKU1
ACTG

SEQ ID NO: 3196 - protein, 7 aa, Corononavirus-HKU1
YFLYMVY

SEQ ID NO: 3197 - protein, 4 aa, Corononavirus-HKU1
STYC

SEQ ID NO: 3198 - protein, 6 aa, Corononavirus-HKU1
IKKSMC

SEQ ID NO: 3199 - protein, 9 aa, Corononavirus-HKU1
NWLEVKIDF

SEQ ID NO: 3200 - protein, 14 aa, Corononavirus-HKU1
ARGKCSYSYNALFT

SEQ ID NO: 3201 - protein, 6 aa, Corononavirus-HKU1
RRCCIE

SEQ ID NO: 3202 - protein, 8 aa, Corononavirus-HKU1
FVIYIIFY

SEQ ID NO: 3203 - protein, 14 aa, Corononavirus-HKU1
FNLFYIIVGFTAYI

SEQ ID NO: 3204 - protein, 7 aa, Corononavirus-HKU1
YSFACLC

SEQ ID NO: 3205 - protein, 4 aa, Corononavirus-HKU1
RYFS

SEQ ID NO: 3206 - protein, 4 aa, Corononavirus-HKU1
FMFC

SEQ ID NO: 3207 - protein, 4 aa, Corononavirus-HKU1
IFPI

SEQ ID NO: 3208 - protein, 9 aa, Corononavirus-HKU1
VHFWVFLLS

SEQ ID NO: 3209 - protein, 12 aa, Corononavirus-HKU1
FYGLPYCCGSYG

SEQ ID NO: 3210 - protein, 7 aa, Corononavirus-HKU1
RYWFYYV

SEQ ID NO: 3211 - protein, 17 aa, Corononavirus-HKU1
SFETWLSCFTFSNLCIC

SEQ ID NO: 3212 - protein, 12 aa, Corononavirus-HKU1
CSVLYTTYSDFL

SEQ ID NO: 3213 - protein, 11 aa, Corononavirus-HKU1
WLCFIIFVYYV

SEQ ID NO: 3214 - protein, 28 aa, Corononavirus-HKU1
WYTTSLLLFRWCYEECFFVYIFGSTYTL

SEQ ID NO: 3215 - protein, 6 aa, Corononavirus-HKU1
WFYKIS

SEQ ID NO: 3216 - protein, 14 aa, Corononavirus-HKU1
RYCTYCKNALYDLL

SEQ ID NO: 3217 - protein, 4 aa, Corononavirus-HKU1
SGCM

SEQ ID NO: 3218 - protein, 8 aa, Corononavirus-HKU1
ICRRGYMF

SEQ ID NO: 3219 - protein, 5 aa, Corononavirus-HKU1
FLGFE

SEQ ID NO: 3220 - protein, 8 aa, Corononavirus-HKU1
KYAWNFLW

SEQ ID NO: 3221 - protein, 6 aa, Corononavirus-HKU1
FVLSIF

SEQ ID NO: 3222 - protein, 12 aa, Corononavirus-HKU1
FNSSYRFLFSYC

SEQ ID NO: 3223 - protein, 21 aa, Corononavirus-HKU1
FYFWSYIGYSRCLGFLLFNKT

SEQ ID NO: 3224 - protein, 7 aa, Corononavirus-HKU1
ACFWRLY

SEQ ID NO: 3225 - protein, 11 aa, Corononavirus-HKU1
CCSYKCYCLVY

SEQ ID NO: 3226 - protein, 30 aa, Corononavirus-HKU1; identical to SEQ ID NO: 294

SEQ ID NO: 3227 - protein, 39 aa, Corononavirus-HKU1; identical to SEQ ID NO: 295

SEQ ID NO: 3228 - protein, 4 aa, Corononavirus-HKU1
ENWC

SEQ ID NO: 3229 - protein, 10 aa, Corononavirus-HKU1
RNISYYFYDY

SEQ ID NO: 3230 - protein, 4 aa, Corononavirus-HKU1
RFLL

SEQ ID NO: 3231 - protein, 6 aa, Corononavirus-HKU1
IKEFCF

SEQ ID NO: 3232 - protein, 4 aa, Corononavirus-HKU1
CCLQ

SEQ ID NO: 3233 - protein, 5 aa, Corononavirus-HKU1
IFEFV

SEQ ID NO: 3234 - protein, 4 aa, Corononavirus-HKU1
VSLL

SEQ ID NO: 3235 - protein, 6 aa, Corononavirus-HKU1
NGYCCL

SEQ ID NO: 3236 - protein, 8 aa, Corononavirus-HKU1
RSGVFSVS

SEQ ID NO: 3237 - protein, 5 aa, Corononavirus-HKU1
SYGNI

SEQ ID NO: 3238 - protein, 29 aa, Corononavirus-HKU1
CLIPTSYSICFYIFFAIRYCKDGISYVKN

SEQ ID NO: 3239 - protein, 4 aa, Corononavirus-HKU1
TLYC

SEQ ID NO: 3240 - protein, 4 aa, Corononavirus-HKU1
CYLW

SEQ ID NO: 3241 - protein, 9 aa, Corononavirus-HKU1
YDFEWFMVR

SEQ ID NO: 3242 - protein, 13 aa, Corononavirus-HKU1
QSLLSSSCYMFIL

SEQ ID NO: 3243 - protein, 6 aa, Corononavirus-HKU1
LFCLIM

SEQ ID NO: 3244 - protein, 4 aa, Corononavirus-HKU1
SYSR

SEQ ID NO: 3245 - protein, 41 aa, Corononavirus-HKU1
FYYNVWADEFNSCVLPDAGLSTCFDSLFTKSLHSKIYFWCC

SEQ ID NO: 3246 - protein, 8 aa, Corononavirus-HKU1
NFYCFSCV

SEQ ID NO: 3247 - protein, 12 aa, Corononavirus-HKU1
WPTTRGISCYYA

SEQ ID NO: 3248 - protein, 17 aa, Corononavirus-HKU1
RFFFVWVMWICWLCINR

SEQ ID NO: 3249 - protein, 17 aa, Corononavirus-HKU1
VCIYASIRAQYWLSHWH

SEQ ID NO: 3250 - protein, 5 aa, Corononavirus-HKU1
FLWSI

SEQ ID NO: 3251 - protein, 9 aa, Corononavirus-HKU1
RCSSCTVAS

SEQ ID NO: 3252 - protein, 6 aa, Corononavirus-HKU1
GLRPNC

SEQ ID NO: 3253 - protein, 10 aa, Corononavirus-HKU1
CYCLALCSYT

SEQ ID NO: 3254 - protein, 7 aa, Corononavirus-HKU1
LCLVCTK

SEQ ID NO: 3255 - protein, 4 aa, Corononavirus-HKU1
CLFY

SEQ ID NO: 3256 - protein, 8 aa, Corononavirus-HKU1
CLGYDKWF

SEQ ID NO: 3257 - protein, 19 aa, Corononavirus-HKU1
PSKSRSCFRCFGFNDRCFY

SEQ ID NO: 3258 - protein, 6 aa, Corononavirus-HKU1
NFIGCY

SEQ ID NO: 3259 - protein, 17 aa, Corononavirus-HKU1
ASIYGISRSSNTRKLYF

SEQ ID NO: 3260 - protein, 4 aa, Corononavirus-HKU1
IGTF

SEQ ID NO: 3261 - protein, 8 aa, Corononavirus-HKU1
RLSTIGWC

SEQ ID NO: 3262 - protein, 5 aa, Corononavirus-HKU1
NKKIY

SEQ ID NO: 3263 - protein, 13 aa, Corononavirus-HKU1
RNNLLDFDIYIFV

SEQ ID NO: 3264 - protein, 7 aa, Corononavirus-HKU1
LYNFCIC

SEQ ID NO: 3265 - protein, 7 aa, Corononavirus-HKU1
MDYIYVY

SEQ ID NO: 3266 - protein, 14 aa, Corononavirus-HKU1
YTYDWCYIMCTLFC

SEQ ID NO: 3267 - protein, 6 aa, Corononavirus-HKU1
FYDVTS

SEQ ID NO: 3268 - protein, 24 aa, Corononavirus-HKU1
AFLFDYVYNSCTLYLVLCKLFSCL

SEQ ID NO: 3269 - protein, 20 aa, Corononavirus-HKU1
RSYLCLALIFCSCCEFYLCL

SEQ ID NO: 3270 - protein, 17 aa, Corononavirus-HKU1
SILWLYFMCFCYFYNYA

SEQ ID NO: 3271 - protein, 9 aa, Corononavirus-HKU1
HFFFDVFGW

SEQ ID NO: 3272 - protein, 44 aa, Corononavirus-HKU1; identical to SEQ ID NO: 341

SEQ ID NO: 3273 - protein, 4 aa, Corononavirus-HKU1
LVVC

SEQ ID NO: 3274 - protein, 10 aa, Corononavirus-HKU1
YILFYRCTLY

SEQ ID NO: 3275 - protein, 27 aa, Corononavirus-HKU1
IDSFELLIYRVYFILLLGIFLSFKQCF

SEQ ID NO: 3276 - protein, 6 aa, Corononavirus-HKU1
NAYGCL

SEQ ID NO: 3277 - protein, 11 aa, Corononavirus-HKU1
NFCSRIALYEC

SEQ ID NO: 3278 - protein, 6 aa, Corononavirus-HKU1
WLTSTP

SEQ ID NO: 3279 - protein, 17 aa, Corononavirus-HKU1
GYFVKFKTAWNRWRASY

SEQ ID NO: 3280 - protein, 9 aa, Corononavirus-HKU1
SFSNSIKID

SEQ ID NO: 3281 - protein, 4 aa, Corononavirus-HKU1
CEMC

SEQ ID NO: 3282 - protein, 14 aa, Corononavirus-HKU1
CCFVKLFTAFACCF

SEQ ID NO: 3283 - protein, 5 aa, Corononavirus-HKU1
VVAVL

SEQ ID NO: 3284 - protein, 11 aa, Corononavirus-HKU1
NTIYFRFKCSF

SEQ ID NO: 3285 - protein, 15 aa, Corononavirus-HKU1
ACSIIDCFIRQSCCS

SEQ ID NO: 3286 - protein, 6 aa, Corononavirus-HKU1
VSCKYR

SEQ ID NO: 3287 - protein, 4 aa, Corononavirus-HKU1
LCSR

SEQ ID NO: 3288 - protein, 8 aa, Corononavirus-HKU1
YCFAGFAK

SEQ ID NO: 3289 - protein, 5 aa, Corononavirus-HKU1
VCKYG

SEQ ID NO: 3290 - protein, 7 aa, Corononavirus-HKU1
SRKEKFG

SEQ ID NO: 3291 - protein, 11 aa, Corononavirus-HKU1
STTDKTVRKGM

SEQ ID NO: 3292 - protein, 15 aa, Corononavirus-HKU1
SCSSQTGTYGRPSTY

SEQ ID NO: 3293 - protein, 4 aa, Corononavirus-HKU1
RGSD

SEQ ID NO: 3294 - protein, 10 aa, Corononavirus-HKU1
SCFRFADNAF

SEQ ID NO: 3295 - protein, 8 aa, Corononavirus-HKU1
SGFKFYSG

SEQ ID NO: 3296 - protein, 13 aa, Corononavirus-HKU1
RLCTFECYSSAGC

SEQ ID NO: 3297 - protein, 8 aa, Corononavirus-HKU1
YFNYNNTR

SEQ ID NO: 3298 - protein, 7 aa, Corononavirus-HKU1
CLCCICW

SEQ ID NO: 3299 - protein, 10 aa, Corononavirus-HKU1
CMAYTDCSRC

SEQ ID NO: 3300 - protein, 7 aa, Corononavirus-HKU1
LASCYYC

SEQ ID NO: 3301 - protein, 5 aa, Corononavirus-HKU1
CCYAE

SEQ ID NO: 3302 - protein, 4 aa, Corononavirus-HKU1
VDAS

SEQ ID NO: 3303 - protein, 6 aa, Corononavirus-HKU1
IKNTSC

SEQ ID NO: 3304 - protein, 7 aa, Corononavirus-HKU1
HSYSMLL

SEQ ID NO: 3305 - protein, 6 aa, Corononavirus-HKU1
NSLCCS

SEQ ID NO: 3306 - protein, 4 aa, Corononavirus-HKU1
DNKR

SEQ ID NO: 3307 - protein, 8 aa, Corononavirus-HKU1
WKLCCFRA

SEQ ID NO: 3308 - protein, 6 aa, Corononavirus-HKU1
IFYTRC

SEQ ID NO: 3309 - protein, 5 aa, Corononavirus-HKU1
VSLFY

SEQ ID NO: 3310 - protein, 11 aa, Corononavirus-HKU1
RVGCWYFIFNN

SEQ ID NO: 3311 - protein, 7 aa, Corononavirus-HKU1
IAGWCCY

SEQ ID NO: 3312 - protein, 13 aa, Corononavirus-HKU1
FFYTFIMCIFCRS

SEQ ID NO: 3313 - protein, 15 aa, Corononavirus-HKU1
ENLFRLYTTRWCTYN

SEQ ID NO: 3314 - protein, 10 aa, Corononavirus-HKU1
SCWYWYGYYY

SEQ ID NO: 3315 - protein, 26 aa, Corononavirus-HKU1
SRFLWWCLSLYLLPCTCRASRCRWFV

SEQ ID NO: 3316 - protein, 18 aa, Corononavirus-HKU1
ICTSPFGYKRSYSLCVNT

SEQ ID NO: 3317 - protein, 24 aa, Corononavirus-HKU1
CLSSLWILERWQLFLCRFRCRCSI

SEQ ID NO: 3318 - protein, 2723 aa, Corononavirus-HKU1
RFKFFKRVRGTSVNARLVPCASGLSTDVQLRAFDICNTNRAGIGLYYKVNCCRFQRIDDDGNKLDKFFVVKRTNLEVYNKEKTYYELTKSCGVVAEHDFFTFDIDGSRVPHIVRKNLSKYTMLDLCYALRHFDCNDCSVLCEILCEYADCKESYFSKKDWYDFVENPDIINIYKKLGPIFNRALLNTVSFADTLVKVGLVGVLTLDNQDLYGQWYDFGDFIQTAPGFGVAVADSYYSYMMPMLTMCHVLDCELFVNDSYRQFDLVQYDFTDYKLELFNKYFKYWGMKYHPNTVDCDNDRCIIHCANFNILFSMVLPNTCFGPLVRQIFVDGVPFVVSIGYHYKELGVVMNLDVDTHRYRLSLKDLLLYAADPAMHVASASALLDLRTCCFSVAAITSGIKFQTVKPGNFNQDFYEFVKSKGLFKEGSTVDLKHFFFTQDGNAAITDYNYYKYNLPTMVDIKQLLFVLEVVYKYFEIYDGGCIPASQVIVNNYDKSAGYPFNKFGKARLYYEALSFEEQNEIYAYTKRNVLPTLTQMNLKYAISAKNRARTVAGVSILSTMTGRMFHQKCLKSIAATRGVPVVIGTTKFYGGWDDMLRHLIKDVDNPVLMGWDYPKCDRAMPNILRIVSSLVLARKHEFCCSHGDRFYRLANECAQVLSEIVMCGGCYYVKPGGTSSGDATTAFANSVFNICQAVTANVCSLMACNGHKIEDLSIRNLQKRLYSNVYRTDYVDYTFVNEYYEFLCKHFSMMILSDDGVVCYNSDYASKGYIANISVFQQVLYYQNNVFMSESKCWVENDITNGPHEFCSQHTMLVKIDGDYVYLPYPDPSRILGAGCFVDDLLKTDSVLLIERFVSLAIDAYPLVHHENEEYQKVFRVYLEYIKKLYNDLGNQILDSYSVILSTCDGLKFTDESFYKNMYLKSAVMQSVGACVVCSSQTSLRCGSCIRKPLLCCKCCYDHVMATNHKYVLSVSPYVCNAPNCDVSDVTKLYLGGMSYYCENHKPHYSFKLVMNGMVFGLYKQSCTGSPYIDDFNKIASCKWTEVDDYVLANECIERLKLFAAETQKATEEAFKQSYASATIQEIVSDREIILCWETGKVKPPLNKNYVFTGYHFTSTGKTVLGEYVFDKSELTNGVYYRATTTYKLSIGDVFVLTSHSVANLSAPTLVPQENYASIRFSSVYSVPLLFQTNVANYQHIGMKRYCTVQGPPGTGKSHLAIGLAVYYYTARVVYTAASHAAVDALCEKAYKFLNINDCTRIIPAKVRVDCYDKFKINDTTCKYVFTTINALPELVTDIVVVDEVSMLTNYELSVINARVKAKHYVYIGDPAQLPAPRVLLSKGSLEPRHFNSITKIMCCLGPDIFLGNCYRCPKEIVETVSALVYDNKLKAKNDNSSLCFKVYFKGQTTHESSSAVNIQQIYLISKFLKANPVWNSAVFISPYNSQNYVAKRILGVQTQTVDSAQGSEYDYVIYSQTAETAHSINVNRFNVAITRAKKGIFCVMSNMQLFESLNFITLPLDKIQNQTLSRLHCTTNLFKDCSKNFLGYHPAHAPSFLSVDDKYKVNEDLAVCLNICEPVLTYSRLISLMGFKLDLTLDGYSKFFITKDEAIKRVRGWVGFDVEGAHATRDNIGTNFPLQIGFSTGVDFVVEATGLFAERDCYIFKRTVAKAPPGDNFKHLIPLMSKGQKWDVVRIRIVQMLSDYLLDLSDSVVFITWSASFELTCLRYFAKLGRELNCDVCPNRATCYNSRTGYYGCWRHSYTCDYVYNPLIVDIQQWGYTGSLTSNHDIICNVHKGAHVASSDAIMTRCLAIYDCFCKSVNWNLEYPIISNEVSINTSCRLLQRVMLKAAMLCNRYNLCYDIGNPKGIACVKDYEFKFYDASPVVKSVKQLFYVYDVHKDNFKDGLCMFWNCNVDKYPSNSIVCRFDTRVLNKLNLPGCNGGSLYVNKHAFHTNPFTRTVFENLKPMPFFYYSDTPCVYVDGLESKQVDYVPLRSATCITRCNLGGAVCSKHAEDYCKYLESYNVATTAGFTFWVYKTFDFYNLWNTFTMLQSLENVIYNLVNAGHYDGRIGELPCAIMNDKVVVKINNVDTVIFKNNTSLPTNIAVELFTKRSIRHHPELKILRNLNIDICWKHVLWDYVKDSLFCSSTYGVCKYTDLNFIENLNVLFDGRDNGALEAFRKARNGVFISTGKLSSLSMIKGPQRADLNGVIVDKVGELNVEFWFAMRKDGDDVIFSRADSLSPSHYWSPQGNLGGNCAGNASGNDALARFTIFTQSRVLSTFEPRSDLERDFIDMEDSLFIAKYGLEDYAFDHIVYGSFNYKVIGGLHLLIGLFRRLKKSNLVIQEFLQYDSSIHSYFITDQECGSSKSVCTVIDLLLDDFVVIVKSLNLNCVSKVVNINVDFKDFQFMLWCNDNKIMTFYPKMQATSDWKPGYSMPVLYKYLNVPLERVSLWNYGKAINLPTGCMMNVAKYTQLCQYLNTTTLAVPVNMRVLHLGAGSDKEVAPGSAVLRQWLPSGSILVDNDLNPFVSDSLVTYFGDCMTLPFDCHWDLIISDMYDPLTKNIGDYNVSKDGFFTYICYLIRDKLSLGGSVAIKITEFSWNADLYKLMSYFAFWTVFCTNVNASSSEGFLIGINYLGKSCFEIDGNVMHANYLFWRNSTTWNGGAYSLFDMSKFSLKLAGTAVVNLRPDQLNDLVYSLIERGKLLVRDTRKEIFVGDSLVNTC

SEQ ID NO: 3319 - protein, 12 aa, Corononavirus-HKU1
IFQFVNIKSKLC

SEQ ID NO: 3320 - protein, 15 aa, Corononavirus-HKU1
LYFYFLIFVMVLMNL

SEQ ID NO: 3321 - protein, 5 aa, Corononavirus-HKU1
MLCLI

SEQ ID NO: 3322 - protein, 19 aa, Corononavirus-HKU1
TMTGFYLVIVVLIVTILII

SEQ ID NO: 3323 - protein, 76 aa, Corononavirus-HKU1
KLKIMVIWIFTLVCVIMVKFHLVLVILFLRVIILPGFIITLARVIKLFFMRVLISILIIGLSASLMVVMMYGFLTR

SEQ ID NO: 3324 - protein, 65 aa, Corononavirus-HKU1
GFIVLYILIWLFFAILPLLIFFTIFLFLLRLIFVIVIFYHLIILFLLVLIILRTFISLYQGVLCI

SEQ ID NO: 3325 - protein, 32 aa, Corononavirus-HKU1
YLFVFLNLILVSTIIIWILALLMVILILFLLI

SEQ ID NO: 3326 - protein, 131 aa, Corononavirus-HKU1
IVHIFLLNLVLIKFFLLVLFYPYLLKLFALINLNNLYPCRLLILGGTIFVHRILHYPMHVSCLIVIFAILLVIMLANMILIMVIMVLLLFYLVFYIMSLVFLIMAPFCMTILHQFGLVFLLVIVLHLLILN

SEQ ID NO: 3327 - protein, 17 aa, Corononavirus-HKU1
IVSMILCLLFYKVFYYF

SEQ ID NO: 3328 - protein, 10 aa, Corononavirus-HKU1
LYCLLCFYFF

SEQ ID NO: 3329 - protein, 25 aa, Corononavirus-HKU1
FTMANIKSKHVFNYFYFAYNTSCYR

SEQ ID NO: 3330 - protein, 10 aa, Corononavirus-HKU1
NHSAYKRGCC

SEQ ID NO: 3331 - protein, 11 aa, Corononavirus-HKU1
CISWFGHILCS

SEQ ID NO: 3332 - protein, 15 aa, Corononavirus-HKU1
PCLFKYYLVIYRLFS

SEQ ID NO: 3333 - protein, 7 aa, Corononavirus-HKU1
RLGFKGF

SEQ ID NO: 3334 - protein, 7 aa, Corononavirus-HKU1
IFEYSLV

SEQ ID NO: 3335 - protein, 7 aa, Corononavirus-HKU1
TTFSVRF

SEQ ID NO: 3336 - protein, 4 aa, Corononavirus-HKU1
WYFF

SEQ ID NO: 3337 - protein, 5 aa, Corononavirus-HKU1
YYSYR

SEQ ID NO: 3338 - protein, 24 aa, Corononavirus-HKU1
YFLYYCCSTSQWYFGDYSLSVYYV

SEQ ID NO: 3339 - protein, 6 aa, Corononavirus-HKU1
ISSHCL

SEQ ID NO: 3340 - protein, 4 aa, Corononavirus-HKU1
ILAH

SEQ ID NO: 3341 - protein, 8 aa, Corononavirus-HKU1
FFGTFMLV

SEQ ID NO: 3342 - protein, 5 aa, Corononavirus-HKU1
EKFYL

SEQ ID NO: 3343 - protein, 32 aa, Corononavirus-HKU1
CFCRLAVFSFLSRTWCFLCILCRCRYAYHFLI

SEQ ID NO: 3344 - protein, 17 aa, Corononavirus-HKU1
FIFRYYFISLLCYAFDL

SEQ ID NO: 3345 - protein, 6 aa, Corononavirus-HKU1
GYIFKY

SEQ ID NO: 3346 - protein, 10 aa, Corononavirus-HKU1
NFRILGYTAI

SEQ ID NO: 3347 - protein, 5 aa, Corononavirus-HKU1
TSVSS

SEQ ID NO: 3348 - protein, 5 aa, Corononavirus-HKU1
ARCYY

SEQ ID NO: 3349 - protein, 6 aa, Corononavirus-HKU1
NSIFCT

SEQ ID NO: 3350 - protein, 4 aa, Corononavirus-HKU1
YWCL

SEQ ID NO: 3351 - protein, 17 aa, Corononavirus-HKU1
FVWFYCKACCNCLSSDS

SEQ ID NO: 3352 - protein, 5 aa, Corononavirus-HKU1
CTFTS

SEQ ID NO: 3353 - protein, 12 aa, Corononavirus-HKU1
LQFKHFTSSSSC

SEQ ID NO: 3354 - protein, 4 aa, Corononavirus-HKU1
FFFL

SEQ ID NO: 3355 - protein, 5 aa, Corononavirus-HKU1
QVCYT

SEQ ID NO: 3356 - protein, 4 aa, Corononavirus-HKU1
SQTR

SEQ ID NO: 3357 - protein, 12 aa, Corononavirus-HKU1
FAIGQFWLFAII

SEQ ID NO: 3358 - protein, 7 aa, Corononavirus-HKU1
LQNRYFF

SEQ ID NO: 3359 - protein, 6 aa, Corononavirus-HKU1
FLSIVL

SEQ ID NO: 3360 - protein, 4 aa, Corononavirus-HKU1
FTFS

SEQ ID NO: 3361 - protein, 5 aa, Corononavirus-HKU1
SIFLE

SEQ ID NO: 3362 - protein, 5 aa, Corononavirus-HKU1
EVWFW

SEQ ID NO: 3363 - protein, 4 aa, Corononavirus-HKU1
CVFL

SEQ ID NO: 3364 - protein, 4 aa, Corononavirus-HKU1
RCLF

SEQ ID NO: 3365 - protein, 5 aa, Corononavirus-HKU1
SLFFC

SEQ ID NO: 3366 - protein, 12 aa, Corononavirus-HKU1
QRLLPLCRSVCC

SEQ ID NO: 3367 - protein, 10 aa, Corononavirus-HKU1
ASFCHLSCWY

SEQ ID NO: 3368 - protein, 12 aa, Corononavirus-HKU1
ISSLRLGYYSLC

SEQ ID NO: 3369 - protein, 5 aa, Corononavirus-HKU1
MFLST

SEQ ID NO: 3370 - protein, 7 aa, Corononavirus-HKU1
PHFYLFS

SEQ ID NO: 3371 - protein, 12 aa, Corononavirus-HKU1
HMSSKEGRCWYR

SEQ ID NO: 3372 - protein, 7 aa, Corononavirus-HKU1
TLSRSWY

SEQ ID NO: 3373 - protein, 9 aa, Corononavirus-HKU1
GKMWYTIKS

SEQ ID NO: 3374 - protein, 4 aa, Corononavirus-HKU1
FLFL

SEQ ID NO: 3375 - protein, 7 aa, Corononavirus-HKU1
CLFGLVF

SEQ ID NO: 3376 - protein, 6 aa, Corononavirus-HKU1
SLQYFF

SEQ ID NO: 3377 - protein, 5 aa, Corononavirus-HKU1
WHHLF

SEQ ID NO: 3378 - protein, 4 aa, Corononavirus-HKU1
FVIF

SEQ ID NO: 3379 - protein, 7 aa, Corononavirus-HKU1
SFYWCLC

SEQ ID NO: 3380 - protein, 10 aa, Corononavirus-HKU1
SLWHHRPRYF

SEQ ID NO: 3381 - protein, 7 aa, Corononavirus-HKU1
RSFCGLL

SEQ ID NO: 3382 - protein, 6 aa, Corononavirus-HKU1
LAESFV

SEQ ID NO: 3383 - protein, 4 aa, Corononavirus-HKU1
YYWF

SEQ ID NO: 3384 - protein, 4 aa, Corononavirus-HKU1
RFFD

SEQ ID NO: 3385 - protein, 10 aa, Corononavirus-HKU1
NLHYTSLLFW

SEQ ID NO: 3386 - protein, 17 aa, Corononavirus-HKU1
SVCCILSKFFFTSFALS

SEQ ID NO: 3387 - protein, 4 aa, Corononavirus-HKU1
LCFE

SEQ ID NO: 3388 - protein, 10 aa, Corononavirus-HKU1
YFFYLTTILF

SEQ ID NO: 3389 - protein, 9 aa, Corononavirus-HKU1
LSWLCFECC

SEQ ID NO: 3390 - protein, 6 aa, Corononavirus-HKU1
LFCILL

SEQ ID NO: 3391 - protein, 4 aa, Corononavirus-HKU1
FAYG

SEQ ID NO: 3392 - protein, 4 aa, Corononavirus-HKU1
WVLY

SEQ ID NO: 3393 - protein, 8 aa, Corononavirus-HKU1
LCFTLFSA

SEQ ID NO: 3394 - protein, 11 aa, Corononavirus-HKU1
RYFFSLSLCNF

SEQ ID NO: 3395 - protein, 6 aa, Corononavirus-HKU1
NCWWFI

SEQ ID NO: 3396 - protein, 5 aa, Corononavirus-HKU1
DSDSY

SEQ ID NO: 3397 - protein, 6 aa, Corononavirus-HKU1
LYHSWS

SEQ ID NO: 3398 - protein, 5 aa, Corononavirus-HKU1
RIYSD

SEQ ID NO: 3399 - protein, 7 aa, Corononavirus-HKU1
LFSFCLL

SEQ ID NO: 3400 - protein, 5 aa, Corononavirus-HKU1
LCCLS

SEQ ID NO: 3401 - protein, 10 aa, Corononavirus-HKU1
FIVGIWHFLR

SEQ ID NO: 3402 - protein, 7 aa, Corononavirus-HKU1
YYSVAGC

SEQ ID NO: 3403 - protein, 8 aa, Corononavirus-HKU1
CFNARCYT

SEQ ID NO: 3404 - protein, 14 aa, Corononavirus-HKU1
ISSRLFRFTMWFFV

SEQ ID NO: 3405 - protein, 19 aa, Corononavirus-HKU1
IFVRGFIIQQGQTFRCRFC

SEQ ID NO: 3406 - protein, 4 aa, Corononavirus-HKU1
LHWW

SEQ ID NO: 3407 - protein, 8 aa, Corononavirus-HKU1
RSSLCAIF

SEQ ID NO: 3408 - protein, 7 aa, Corononavirus-HKU1
SITSHFI

SEQ ID NO: 3409 - protein, 29 aa, Corononavirus-HKU1
DSNFWLYYSCYCGGYVSAMVCCCWCTIFS

SEQ ID NO: 3410 - protein, 9 aa, Corononavirus-HKU1
WFGCYYGCS

SEQ ID NO: 3411 - protein, 6 aa, Corononavirus-HKU1
ESKVNS

SEQ ID NO: 3412 - protein, 12 aa, Corononavirus-HKU1
SSSFYPEWFYCY

SEQ ID NO: 3413 - protein, 4 aa, Corononavirus-HKU1
LCSC

SEQ ID NO: 3414 - protein, 5 aa, Corononavirus-HKU1
NSKCR

SEQ ID NO: 3415 - protein, 4 aa, Corononavirus-HKU1
CSST

SEQ ID NO: 3416 - protein, 6 aa, Corononavirus-HKU1
FVTTII

SEQ ID NO: 3417 - protein, 4 aa, Corononavirus-HKU1
IWCY

SEQ ID NO: 3418 - protein, 10 aa, Corononavirus-HKU1
FFFTRNFVSP

SEQ ID NO: 3419 - protein, 7 aa, Corononavirus-HKU1
FRSSGSD

SEQ ID NO: 3420 - protein, 14 aa, Corononavirus-HKU1
WSFDCFKCLCFSTA

SEQ ID NO: 3421 - protein, 4 aa, Corononavirus-HKU1
YYTY

SEQ ID NO: 3422 - protein, 7 aa, Corononavirus-HKU1
GWSFSCY

SEQ ID NO: 3423 - protein, 12 aa, Corononavirus-HKU1
KSIPSYKFLWQW

SEQ ID NO: 3424 - protein, 18 aa, Corononavirus-HKU1
PHFIIGSKCSLWFAFHSF

SEQ ID NO: 3425 - protein, 4 aa, Corononavirus-HKU1
TYFF

SEQ ID NO: 3426 - protein, 12 aa, Corononavirus-HKU1
NCLSKSRFMFIR

SEQ ID NO: 3427 - protein, 4 aa, Corononavirus-HKU1
RYCT

SEQ ID NO: 3428 - protein, 5 aa, Corononavirus-HKU1
ARLFY

SEQ ID NO: 3429 - protein, 6 aa, Corononavirus-HKU1
FLDVYW

SEQ ID NO: 3430 - protein, 10 aa, Corononavirus-HKU1
FLLLPRTNFR

SEQ ID NO: 3431 - protein, 6 aa, Corononavirus-HKU1
KCCFHE

SEQ ID NO: 3432 - protein, 6 aa, Corononavirus-HKU1
SSIYLS

SEQ ID NO: 3433 - protein, 6 aa, Corononavirus-HKU1
FYTKFV

SEQ ID NO: 3434 - protein, 7 aa, Corononavirus-HKU1
SRVFSLV

SEQ ID NO: 3435 - protein, 7 aa, Corononavirus-HKU1
KSYFYST

SEQ ID NO: 3436 - protein, 8 aa, Corononavirus-HKU1
CYFFRSVL

SEQ ID NO: 3437 - protein, 8 aa, Corononavirus-HKU1
NECYSGIY

SEQ ID NO: 3438 - protein, 4 aa, Corononavirus-HKU1
IFEQ

SEQ ID NO: 3439 - protein, 5 aa, Corononavirus-HKU1
RNRYL

SEQ ID NO: 3440 - protein, 34 aa, Corononavirus-HKU1
MALVHLVVNCHFIYNFSYDTFLYMLLYWLWFSMF

SEQ ID NO: 3441 - protein, 5 aa, Corononavirus-HKU1
VWGSQ

SEQ ID NO: 3442 - protein, 51 aa, Corononavirus-HKU1
LDFKSKLYIWKFGGLAINILLLLENLVSQILRICVLNIIIANLVLVIVLYL

SEQ ID NO: 3443 - protein, 29 aa, Corononavirus-HKU1
TFGVVSLVNLLLILFYVVMTPLIRIILVL

SEQ ID NO: 3444 - protein, 16 aa, Corononavirus-HKU1
LVLLVMVTLFLRLFLN

SEQ ID NO: 3445 - protein, 99 aa, Corononavirus-HKU1
LNQHLILSLGELKHLISMVDVFFTDTAWYVGQIFFLVLSCVIFLIFVVALLATIKLCIQICGFCNIFIISPSAYVYNRGRQLYKSYSEHVIPSTLDDLI

SEQ ID NO: 3446 - protein, 16 aa, Corononavirus-HKU1
MNQFFLIGILIKLLHS

SEQ ID NO: 3447 - protein, 8 aa, Corononavirus-HKU1
KNGISLWV

SEQ ID NO: 3448 - protein, 24 aa, Corononavirus-HKU1
YYFSLLSYCSLVIRVVVCLFILLR

SEQ ID NO: 3449 - protein, 8 aa, Corononavirus-HKU1
LFFGLCGH

SEQ ID NO: 3450 - protein, 8 aa, Corononavirus-HKU1
LYLIAFML

SEQ ID NO: 3451 - protein, 50 aa, Corononavirus-HKU1
IISFLGFLYCLLLFLLLYGFYILSTVFGFLSELAVGGVLTQRLIILCVLI

SEQ ID NO: 3452 - protein, 15 aa, Corononavirus-HKU1
KVRCMLGQLLRTIIH

SEQ ID NO: 3453 - protein, 30 aa, Corononavirus-HKU1
RLLLSVVIFIYRVLNLALVTRLPICLFMLL

SEQ ID NO: 3454 - protein, 13 aa, Corononavirus-HKU1
LRCKSSVLINVPF

SEQ ID NO: 3455 - protein, 31 aa, Corononavirus-HKU1
MLIVVLLFLLSLKLVTIVYLLVNLVVWILPC

SEQ ID NO: 3456 - protein, 220 aa, Corononavirus-HKU1
ELKSKLLGCLILPVIMLEVEAPLEIVQESSRKLLGLTNLSEAIKPIIEAENPNPNSLCLLNHKETLSHIIPGSLGLPNFKKVETLNFQMVKEYPLLTGYPLLKQKDIGINTTGVLLKQLMVNKSSCYQDGISTISVPVHMPVHPMVMPTKVSSGSLVTKLTLLFPPMFRQGILLFKKLSLLGFRLVRFCLKAIMLKAQEGLLLIAGQVHVLNHVDPIIVH

SEQ ID NO: 3457 - protein, 12 aa, Corononavirus-HKU1
VEVILILDILIL

SEQ ID NO: 3458 - protein, 37 aa, Corononavirus-HKU1
NLIWLMRLLVLSWPSLVKILNLSKLPSKMLRKLGIKF

SEQ ID NO: 3459 - protein, 32 aa, Corononavirus-HKU1
NLAKSELLINFVMFNSVLVKEDRSKTLVILKC

SEQ ID NO: 3460 - protein, 14 aa, Corononavirus-HKU1
SLVLMILNFLFLLN

SEQ ID NO: 3461 - protein, 12 aa, Corononavirus-HKU1
PLHQVLFSLALN

SEQ ID NO: 3462 - protein, 37 aa, Corononavirus-HKU1
SCLKETLMLIHLLKTLLNFVILVLLGLIVLYLVLRQL

SEQ ID NO: 3463 - protein, 6 aa, Corononavirus-HKU1
KFLKRI

SEQ ID NO: 3464 - protein, 14 aa, Corononavirus-HKU1
MLMLILIRTLFLVR

SEQ ID NO: 3465 - protein, 21 aa, Corononavirus-HKU1
VLNLSVKEVLNNHLNRLTLLI

SEQ ID NO: 3466 - protein, 26 aa, Corononavirus-HKU1
  misc_feature (24)..(24): The 'Xaa' at location 24 stands for Ile, or Met.
VLILSTFQMILLLRIIVYLLLLMXLM

SEQ ID NO: 3467 - protein, 10 aa, Corononavirus-HKU1
KTLLLNENES

SEQ ID NO: 3468 - protein, 5 aa, Corononavirus-HKU1
FDTRW

SEQ ID NO: 3469 - protein, 21 aa, Corononavirus-HKU1
PLAISRNRTLSIRMNSCCYNR

SEQ ID NO: 3470 - protein, 8 aa, Corononavirus-HKU1
SRLLQTIY

SEQ ID NO: 3471 - protein, 9 aa, Corononavirus-HKU1
LVETLYLNI

SEQ ID NO: 3472 - protein, 5 aa, Corononavirus-HKU1
GLAVV

SEQ ID NO: 3473 - protein, 11 aa, Corononavirus-HKU1
TPPGRASNYSI

SEQ ID NO: 3474 - protein, 18 aa, Corononavirus-HKU1
YMIEINYSLLEELQKKKK

SEQ ID NO: 3475 - DNA, 29836 bp, Corononavirus-HKU1; identical to SEQ ID NO: 2919
  CDS (2)..(29836)
  modified_base (29514): a, c, g, t, unknown or other

SEQ ID NO: 3476 - protein, 38 aa, Corononavirus-HKU1; identical to SEQ ID NO: 458

SEQ ID NO: 3477 - protein, 24 aa, Corononavirus-HKU1
SCILLSTLFISLPVTCWLSSASLP

SEQ ID NO: 3478 - protein, 4443 aa, Corononavirus-HKU1
VAMIKTSKYGLGFKWAPEFRWLLPDAAEELASPMKSDEGGLCPSTGQAMESVGFVYDNHVKIDCRCILGQEWHVQSNLIRDIFVHEDLHVVEVLTKTAVKSGTAILIKSPLHSLGGFPKGYVMGLFRSYKTKRYVVHHLSMTTSTTNFGEDFLGWIVPFGFMPSYVHKWFQFCRLYIEESDLIISNFKFDDYDFSVEDAYAEVHAEPKGKYSQKAYALLRQYRGIKPVLFVDQYGCDYSGKLADCLQAYGHYSLQDMRQKQSVWLANCDFDIVVAWHVVRDSRFVMRLQTIATICGIKYVAQPTEDVVDGAVVIREPVHLLSADAIVLKLPSLMKVMTHMDDFSIKSIYNVDLCDCGFVMQYGYVDCFNDNCDFYGWVSGNMMDGFSCPLCCTVYDSSEVKAQSSGVIPENPVLFTNSTDTVNPDSFNLYGYSVTPFGSCIYWSPRPGLWIPIIKSSVKSYDDLVYSGVVGCKSIVKETALITHALYLDYVQCKCGNLEQNHILGVNNSWCRQLLLNRGDYNMLLKNIDLFVKRRADFACKFAVCGDGFVPFLLDGLIPRSYYLIQSGIFFTSLMSQFSQEVSDMCLKMCILFMDRVSVATFYIEHYVNRLVTQFKLLGTTLVNKMVNWFNTMLDASAPATGWLLYQLLNGLFVVSQANFNFVALIPDYAKILVNKFYTFFKLLLECVTVDVLKDMPVLKTINGLVCIVGNKFYNVSTGLIPGFVLPCNAQEQQIYFFEGVAESVIVEDDVIENVKSSLSSYEYCQPPKSVEKICIIDNMYMGKCGDKFFPIVMNDKNICLLDQAWRFPCAGRKVNFNEKPVVMEIPSLMTVKVMFDLDSTFDDILGKVCSEFEVEKGVTVDDFVAVVCDAIENALNSCKDHPVVGYQVRAFLNKLNENVVYLFDEAGDEAMASRMYCTFAIEDVEDVISSEAVEDTIDGVVEDTINDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEEIVTGDNDDQIVVTGDDVDDIESVYDFDTYKALLVFNDVYNDALFVSYGSSVETETYFKVNGLWSPTITHTNCWLRSVLLVMQKLPFKFKDLAIENMWLSYKVGYNQSFVDYLLTTIPKAIVLPQGGYVADFAYWFLNQFDINAYANWCCLKCGFSFDLNGLDAVFFYGDIVSHVCKCGHNMTLIAADLPCTLHFSLFDDNFCAFCTPKKIFIAACAVDVNVCHSVAVIGDEQIDGKFVTKFSGDKFDFIVGYGMSFSMSSFELAQLYGLCITPNVCFVKGDIINVARLVKADVIVNPANGHMLHGGGVAKAIAVAAGKKFSKETAAMVKSKGVCQVGDCYVSTGGKLCKTILNIVGPDARQDGRQSYVLLARAYKHLNNYDCCLSTLISAGIFSVPADVSLTYLLGVVDKQVILVSNNKEDFDIIQKCQITSVVGTKALAVRLTANVGRVIKFETDAYKLFLSGDDCFVSNSSVIQEVLLLRHDIQLNNDVRDYLLSKMTSLPKDWRLINKFDVINGVKTVKYFECPNSIYICSQGKDFGYVCDGSFYKATVNQVCVLLAKKIDVLLTVDGVNFKSISLTVGEVFGKILGNVFCDGIDVTKLKCSDFYADKILYQYENLSLADISAVQSSFGFDQQQLLAYYNFLTVCKWSVVVNGPFFSFEQSHNNCYVNVACLMLQHINLKFNKWQWQEAWYEFRAGRPHRLVALVLAKGHFKFDEPSDATDFIRVVLKQADLSGAICELELICDCGIKQESRVGVDAVMHFGTLAKTDLFNGYKIGCNCAGRIVHCTKLNVPFLICSNTPLSKDLPDDVVAANMFMGVGVGHYTHLKCGSPYQHYDACSVKKYTGVSGCLTDCLYLKNLTQTFTSMLTNYFLDDVEMVAYNPDLSQYYCDNGKYYTKPIIKAQFKPFAKVDGVYTNFKLVGHDICAQLNDKLGFNVDLPFVEYKVTVWPVATGDVVLASDDLYVKRYFKGCETFGKPVIWLCHDEASLNSLTYFNKPSFKSENRYSVLSVDSVSEESQGNVVTSVMESQISTKEVKLKGVRKTVKIEDAIIVNDENSSIKVVKSLSLVDVWDMYLTGCDYVVWVANELSRLVKSPTVREYIRYGIKPITIPIDLLCLRDDNQTLLVPKIFKARAIEFYGFLKWLFIYVFSLLHFTNDKTIFYTTEIASKFTFNLFCLALKNAFQTFRWSIFIKGFLVVATVFLFWFNFLYINVIFSDFYLPNISVFPIFVGRIVMWIKATFGLVTICDFYSKLGVGFTSHFCNGSFICELCYSGFDMLDTYAAIDFVQYEVDRRVLFDYVSLVKLIVELVIGYSLYTVWFYPLFCLIGLQLFTTWLPDLFMLETMHWLIRFIVFVANMLPAFVLLRFYIVVTAMYKVVGFIRHIVYGCNKAGCLFCYKRNCSVRVKCSTIVGGVIRYYDITANGGTGFCVKHQWNCFNCHSFKPGNTFITVEAAIELSKELKRPVNPTDASHYVVTDIKQVGCMMRLFYDRDGQRVYDDVDASLFVDINNLLHSKVKVVPNLYVVVVESDADRANFLNAVVFYAQSLYRPILLVDKKLITTACNGISVTQTMFDVYVDTFMSHFDVDRKSFNNFVNIAHASLREGVQLEKVLDTFVGCVRKCCSIDSDVETRFITKSMISAVAAGLEFTDENYNNLVPTYLKSDNIVAADLGVLIQNGAKHVQGNVAKAANISCIWFIDTFNQLTADLQHKLKKACVKTGLKLKLTFNKQEASVPILTTPFSLKGGVVLSNLLYILFFISLICFILLWALLPTYSVYKSDIHLPAYASFKVIDNGVVRDISVNDLCFANKFFQFDQWYESTFGSFYYHNSMDCPIVVAVMDEDIGSTMFNVPTKVLRHGFHVLHFLTYAFASDSVQCYTPHIQISYNDFYASGCVLSSLCTMFKRGDGTPHPYCYSDGVMKNASLYTSLVPHTRYSLANSNGFIRFPDVISEGIVRIVRTRSMTYCRVGACEYAEEGICFNFNSSWVLNNDYYRSMPGTFCGRDLFDLFYQFFSSLIRPIDFFSLTASSIFGAILAIVVVLVFYYLIKLKRAFGDYTSVVVINVIVWCINFLMLFVFQVYPICACVYACFYFYVTLYFPSEISVIMHLQWIVMYGAIMPFWFCVTYVAMVIANHVLWLFSYCRKIGVNVCNDSTFEETSLTTFMITKDSYCRLKNSVSDVAYNRYLSLYNKYRYYSGKMDTAAYREAACSQLAKAMETFNHNNGNDVLYQPPTASVSTSFLQSGIVKMVSPTSKIEPCIVSVTYGSMTLNGLWLDDKVYCPRHVICLSSNMNEPDYSALLCRVTLGDFTIMSGRMSLTVVSYQMQGCQLVLTVSLQNPYTPKYTFGVVKPGETFTVLAAYNGRPQGAFHVTMRSSYTIKGSFLCGSCGSVGYVLTGDSVKFVYMHQLELSTGCHTGTDFTGNFYGPYRDAQVVQLPVKDYVQTVNVIAWLYAAILNNCAWFVQNDVCSIEDFNVWAMTNGFSQVKADLVLDALASMTGVSIETLLAAIKRLYMGFQGRQILGSCTFEDELAPSDVYQQLAGVKLQSKTKRFIKETIYWILISTFLFSCIISAFVKWTIFMYINTHMIGVTLCVLCFVSFMMLLVKHKHFYLTMYIIPVLCTLFYVNYLVVYKEGFRGLTYVWLSYFVPAVNFTYVYEVFYGCILCVFAIFITMHSINHDIFSLMFLVGRIVTLISMWYFGSNLEEDVLLFITAFLGTYTWTTILSLAIAKIVANWLSVNIFYFTDVPYIKLILLSYLFIGYILSCYWGFFSLLNSVFRMPMGVYNYKISVQELRYMNANGLRPPRNSFEAILLNLKLLGIGGVPVIEVSQIQSKLTDVKCANVVLLNCLQHLHVASNSRLWQYCSILHNEILSTSDLSVAFDKLAQLLIVLFANPAAVDTKCLASIDEVSDDYVQDSTVLQALQSEFVNMASFVEYEVAKKNLADAKNSGSVNQQQIKQLEKACNIAKSVYERDKAVARKLERMADLALTNMYKEARINDKKSKVVSALQTMLFSMVRKLDNQALNSILDNAVKGCVPLNAIPALAANTLTIIIPDKQVFDKVVDNVYVAYAGSVWHIQTVQDADGINKQLTDISVDSNWPLVIIANRYNEVANAVMQNNELMPHKLKIQVVNSGSDMNCNIPTQCYYNNGSSGRIVYAVLSDVDGLKYTKIIKDDGNCVVLELDPPCKFSIQDVKGLKIKYLYFIKGCNTLARGWVVGTLSSTIRLQAGVATEYAANSSILSLCAFSVDPKKTYLDYIQQGGVPIINCVKMLCDHAGTGMAITIKPEATINQDSYGGASVCIYCRARVEHPDVDGLCKLRGKFVQVPLGIKDPILYVLTHDVCQVCGFWRDGSCSCVGSGVAVQSKDLNFLNGFGVLV

SEQ ID NO: 3479 - protein, 12 aa, Corononavirus-HKU1
YPVLVVYLLMFN

SEQ ID NO: 3480 - protein, 12 aa, Corononavirus-HKU1
GHLIFVILIELV

SEQ ID NO: 3481 - protein, 5 aa, Corononavirus-HKU1
VYIIK

SEQ ID NO: 3482 - protein, 7 aa, Corononavirus-HKU1
IVAVFSV

SEQ ID NO: 3483 - protein, 17 aa, Corononavirus-HKU1
MTTVINWISSLLLKELI

SEQ ID NO: 3484 - protein, 11 aa, Corononavirus-HKU1
KFIIKRKLIMS

SEQ ID NO: 3485 - protein, 24 aa, Corononavirus-HKU1
LKVVVLWLNMISLHLILMVVVCHI

SEQ ID NO: 3486 - protein, 10 aa, Corononavirus-HKU1
FVRTSQSILC

SEQ ID NO: 3487 - protein, 52 aa, Corononavirus-HKU1
IFAMHCAILIVMIVQYCVKFFVSMLIVKNPTFLRKIGMILLKILILLIFIKN

SEQ ID NO: 3488 - protein, 17 aa, Corononavirus-HKU1
ALFLIELYLILSVLQIL

SEQ ID NO: 3489 - protein, 33 aa, Corononavirus-HKU1
IIKTCMVNGMILVILYKQLQVLVWQLQILTILI

SEQ ID NO: 3490 - protein, 5 aa, Corononavirus-HKU1
LCVMY

SEQ ID NO: 3491 - protein, 24 aa, Corononavirus-HKU1
IVNYLLMIVIDNSILYSMILLIIS

SEQ ID NO: 3492 - protein, 11 aa, Corononavirus-HKU1
NCLISILSIGV

SEQ ID NO: 3493 - protein, 42 aa, Corononavirus-HKU1
SIILILWIVIMIGVLFIVLILIYYLVWSYLILVLVLLLDKFL

SEQ ID NO: 3494 - protein, 15 aa, Corononavirus-HKU1
MVFRLLFQLVTIIKS

SEQ ID NO: 3495 - protein, 42 aa, Corononavirus-HKU1
TWMLIHTAIVCLLKTYFFMQQILLCMLHLLVLCLIYELVVLV

SEQ ID NO: 3496 - protein, 6 aa, Corononavirus-HKU1
LPLQVV

SEQ ID NO: 3497 - protein, 31 aa, Corononavirus-HKU1
SFKLLNQVILTKIFMSLSKVKACLKRVVQLI

SEQ ID NO: 3498 - protein, 35 aa, Corononavirus-HKU1
NTFSLLKMVMLQLLIIIIISIIYLLWLILSSYCLY

SEQ ID NO: 3499 - protein, 65 aa, Corononavirus-HKU1
KLFISILKFMMVVVYQHHKLLLIIMTKVLVIHLINLVKLDFIMRHYHLRSRMKFMHILNVMCCPL

SEQ ID NO: 3500 - protein, 21 aa, Corononavirus-HKU1
NMLLVLRIELVLLQVFPFLVL

SEQ ID NO: 3501 - protein, 9 aa, Corononavirus-HKU1
QVECFIKNV

SEQ ID NO: 3502 - protein, 9 aa, Corononavirus-HKU1
QLLVVFLLL

SEQ ID NO: 3503 - protein, 16 aa, Corononavirus-HKU1
ELLNFMVAGMICYAIL

SEQ ID NO: 3504 - protein, 29 aa, Corononavirus-HKU1
RMLTTLFLWVGIILNVIVPCQIFCVLLVV

SEQ ID NO: 3505 - protein, 26 aa, Corononavirus-HKU1
FWLVNMNFVVHMVIDSIALRMNVLKF

SEQ ID NO: 3506 - protein, 51 aa, Corononavirus-HKU1
LCVAVAIMLSLVVLAVVMQPLLLLTLFLIYVKLLLLMFVLLWLVMAIRLKI

SEQ ID NO: 3507 - protein, 36 aa, Corononavirus-HKU1; identical to SEQ ID NO: 491

SEQ ID NO: 3508 - protein, 17 aa, Corononavirus-HKU1
VMMVLFVITLIMLVRVI

SEQ ID NO: 3509 - protein, 42 aa, Corononavirus-HKU1
VFFNKFCTIRITFLCLNLNVGLKMILLMVLMNSVHNILCWLR

SEQ ID NO: 3510 - protein, 15 aa, Corononavirus-HKU1
MVTMFIYPIQTLLEF

SEQ ID NO: 3511 - protein, 9 aa, Corononavirus-HKU1
ELVVLLMIY

SEQ ID NO: 3512 - protein, 6 aa, Corononavirus-HKU1
RLTVFF

SEQ ID NO: 3513 - protein, 4 aa, Corononavirus-HKU1
MLTL

SEQ ID NO: 3514 - protein, 15 aa, Corononavirus-HKU1
YTMKMKNTKKFFVYI

SEQ ID NO: 3515 - protein, 11 aa, Corononavirus-HKU1
KNYIMILVIRS

SEQ ID NO: 3516 - protein, 6 aa, Corononavirus-HKU1
IVIVLF

SEQ ID NO: 3517 - protein, 5 aa, Corononavirus-HKU1
VLVMV

SEQ ID NO: 3518 - protein, 12 aa, Corononavirus-HKU1
SSLMNHFIRICI

SEQ ID NO: 3519 - protein, 40 aa, Corononavirus-HKU1
VHVLFVHHRRLCVVAVVYGSLCCVVNVAMIMLWQPIINMF

SEQ ID NO: 3520 - protein, 13 aa, Corononavirus-HKU1
VFHLMCVMHLTVM

SEQ ID NO: 3521 - protein, 25 aa, Corononavirus-HKU1
VMSPNYIWVVCLIIVKTINLIIHLS

SEQ ID NO: 3522 - protein, 17 aa, Corononavirus-HKU1
MVWSLVCINNLVQVHLI

SEQ ID NO: 3523 - protein, 5 aa, Corononavirus-HKU1
MILIR

SEQ ID NO: 3524 - protein, 20 aa, Corononavirus-HKU1
LVVNGQKLMIMFWQMSVLNV

SEQ ID NO: 3525 - protein, 64 aa, Corononavirus-HKU1
SYLLQKLKRQLKKLLNKAMLLLLFKRLLVIEKLFCVGRQVKLNHHLIKIMFSLAIILLVLVRQF

SEQ ID NO: 3526 - protein, 9 aa, Corononavirus-HKU1
VSMFLIKVN

SEQ ID NO: 3527 - protein, 15 aa, Corononavirus-HKU1
LMVFIIALQLLTNFL

SEQ ID NO: 3528 - protein, 5 aa, Corononavirus-HKU1
VMFLS

SEQ ID NO: 3529 - protein, 4 aa, Corononavirus-HKU1
HHIL

SEQ ID NO: 3530 - protein, 13 aa, Corononavirus-HKU1
VHLHLFHKRTMLV

SEQ ID NO: 3531 - protein, 23 aa, Corononavirus-HKU1
DFLVFIAFLCCFKLMLLTISTLE

SEQ ID NO: 3532 - protein, 18 aa, Corononavirus-HKU1
NVIALCKVLLVRASLTLL

SEQ ID NO: 3533 - protein, 8 aa, Corononavirus-HKU1
LFITIQHV

SEQ ID NO: 3534 - protein, 9 aa, Corononavirus-HKU1
FILLLVMLL

SEQ ID NO: 3535 - protein, 10 aa, Corononavirus-HKU1
MHCVKKLISF

SEQ ID NO: 3536 - protein, 14 aa, Corononavirus-HKU1
ILMTVHALYLLKFV

SEQ ID NO: 3537 - protein, 19 aa, Corononavirus-HKU1
IVMISLKLMILLVSMFLLQ

SEQ ID NO: 3538 - protein, 5 aa, Corononavirus-HKU1
MHYQS

SEQ ID NO: 3539 - protein, 20 aa, Corononavirus-HKU1
SQILLLLMKLVCLLIMNCLL

SEQ ID NO: 3540 - protein, 24 aa, Corononavirus-HKU1
MLVLKLNIMYILEILLSYLHHVCY

SEQ ID NO: 3541 - protein, 4 aa, Corononavirus-HKU1
VRVL

SEQ ID NO: 3542 - protein, 10 aa, Corononavirus-HKU1
NLGILILLLK

SEQ ID NO: 3543 - protein, 16 aa, Corononavirus-HKU1
VLIFFWEIVIDVLKKL

SEQ ID NO: 3544 - protein, 38 aa, Corononavirus-HKU1
KLFQHWFMIINLRLRMIIVHYALKYILRDRQHMRVQVL

SEQ ID NO: 3545 - protein, 6 aa, Corononavirus-HKU1
IFNKYI

SEQ ID NO: 3546 - protein, 4 aa, Corononavirus-HKU1
LVNF

SEQ ID NO: 3547 - protein, 25 aa, Corononavirus-HKU1
KLIQFGIVLFLLVLIIVRTMLLSVF

SEQ ID NO: 3548 - protein, 38 aa, Corononavirus-HKU1
VFKHKLLILLKVLNMIMLYIHKQQKQLILLMLIDLMLP

SEQ ID NO: 3549 - protein, 10 aa, Corononavirus-HKU1
LEPRRVFSVL

SEQ ID NO: 3550 - protein, 15 aa, Corononavirus-HKU1
VICNYLNLLILLLYL

SEQ ID NO: 3551 - protein, 25 aa, Corononavirus-HKU1
IKFRIKLYLVCIVLLIFLKIVVKIF

SEQ ID NO: 3552 - protein, 26 aa, Corononavirus-HKU1
VTTQLMLLHFYQLMINIRSTKIWLFV

SEQ ID NO: 3553 - protein, 6 aa, Corononavirus-HKU1
TFVNLF

SEQ ID NO: 3554 - protein, 4 aa, Corononavirus-HKU1
HILV

SEQ ID NO: 3555 - protein, 9 aa, Corononavirus-HKU1
YLSWGLNWI

SEQ ID NO: 3556 - protein, 26 aa, Corononavirus-HKU1
LLMVILNFLLLKTKLLNVLEVGLVLM

SEQ ID NO: 3557 - protein, 17 aa, Corononavirus-HKU1
KEPMLRVTTLEQTFHCK

SEQ ID NO: 3558 - protein, 8 aa, Corononavirus-HKU1
VFQLVLIL

SEQ ID NO: 3559 - protein, 30 aa, Corononavirus-HKU1
LKLLAYLLREIVIYLKELLLKLLLVITLNI

SEQ ID NO: 3560 - protein, 31 aa, Corononavirus-HKU1
YPLCRKVKSGMLLESELFKCCLIIFWIFLIV

SEQ ID NO: 3561 - protein, 13 aa, Corononavirus-HKU1
YLLLGLPVLNLRV

SEQ ID NO: 3562 - protein, 5 aa, Corononavirus-HKU1
GILLN

SEQ ID NO: 3563 - protein, 40 aa, Corononavirus-HKU1
VESSIVMCVLIVQHAIILELVITVVGAIVILVIMCITRLL

SEQ ID NO: 3564 - protein, 10 aa, Corononavirus-HKU1
IYNSGVTQVL

SEQ ID NO: 3565 - protein, 5 aa, Corononavirus-HKU1
LVIMI

SEQ ID NO: 3566 - protein, 16 aa, Corononavirus-HKU1
FVMYIKVHMLHHLMQL

SEQ ID NO: 3567 - protein, 13 aa, Corononavirus-HKU1
QSMIVFVNLLIGI

SEQ ID NO: 3568 - protein, 6 aa, Corononavirus-HKU1
FPMRLV

SEQ ID NO: 3569 - protein, 95 aa, Corononavirus-HKU1
IHLVGYCSVLCLKLPCYVIDTIYVMTLAILKVLLVSKIMNLNSMMLLLLSSLLNSCFMFMMFIKIILRMVYVCFGIVMLINIHLIQLFVDLILGY

SEQ ID NO: 3570 - protein, 45 aa, Corononavirus-HKU1
TSLDVMVVVCMLINMHFILILLPERSLKILNLCHFFTIQILLVCM

SEQ ID NO: 3571 - protein, 12 aa, Corononavirus-HKU1
MVWNPNKLIMCL

SEQ ID NO: 3572 - protein, 10 aa, Corononavirus-HKU1
EALLVSHDVI

SEQ ID NO: 3573 - protein, 20 aa, Corononavirus-HKU1
VVLFVLSMLKIIVNILSLIM

SEQ ID NO: 3574 - protein, 28 aa, Corononavirus-HKU1
LLQQALLFGFIRLLIFIIYGILSLCCRA

SEQ ID NO: 3575 - protein, 13 aa, Corononavirus-HKU1
YIIWLMLVIMMDV

SEQ ID NO: 3576 - protein, 7 aa, Corononavirus-HKU1
VNCLVLL

SEQ ID NO: 3577 - protein, 10 aa, Corononavirus-HKU1
MTKLLLRLIM

SEQ ID NO: 3578 - protein, 14 aa, Corononavirus-HKU1
ILLFLKIIHHFLLI

SEQ ID NO: 3579 - protein, 21 aa, Corononavirus-HKU1
LLNYLQNVVFAITLNLRFLEI

SEQ ID NO: 3580 - protein, 31 aa, Corononavirus-HKU1
ILIFVGSMSFGIMLKIVCFVVLPMVSANTQI

SEQ ID NO: 3581 - protein, 5 aa, Corononavirus-HKU1
ILLKI

SEQ ID NO: 3582 - protein, 11 aa, Corononavirus-HKU1
MYFLMVVTMVL

SEQ ID NO: 3583 - protein, 16 aa, Corononavirus-HKU1
KLLEKQEMVFLLVLEN

SEQ ID NO: 3584 - protein, 4 aa, Corononavirus-HKU1
VVCL

SEQ ID NO: 3585 - protein, 8 aa, Corononavirus-HKU1
LKVRNELI

SEQ ID NO: 3586 - protein, 15 aa, Corononavirus-HKU1
LWIKLENSMLSFGLL

SEQ ID NO: 3587 - protein, 14 aa, Corononavirus-HKU1
EKMVTMLSSAVQTA

SEQ ID NO: 3588 - protein, 11 aa, Corononavirus-HKU1
AQAITGAHKVI

SEQ ID NO: 3589 - protein, 13 aa, Corononavirus-HKU1
VVIVQVMPAVMML

SEQ ID NO: 3590 - protein, 20 aa, Corononavirus-HKU1
RVLLSLLRVVYCQPLNLAQI

SEQ ID NO: 3591 - protein, 12 aa, Corononavirus-HKU1
NGILLIWRIVCL

SEQ ID NO: 3592 - protein, 4 aa, Corononavirus-HKU1
PNMV

SEQ ID NO: 3593 - protein, 7 aa, Corononavirus-HKU1
KIMHLII

SEQ ID NO: 3594 - protein, 9 aa, Corononavirus-HKU1
FMVVLIIKL

SEQ ID NO: 3595 - protein, 6 aa, Corononavirus-HKU1
EVCTCL

SEQ ID NO: 3596 - protein, 5 aa, Corononavirus-HKU1
VYFVD

SEQ ID NO: 3597 - protein, 5 aa, Corononavirus-HKU1
KNLIW

SEQ ID NO: 3598 - protein, 34 aa, Corononavirus-HKU1
FKSFCSMILVFIHISLLIKSVVVVRVFVQLLIYY

SEQ ID NO: 3599 - protein, 9 aa, Corononavirus-HKU1
MTLLLLLSH

SEQ ID NO: 3600 - protein, 27 aa, Corononavirus-HKU1
IVLVKLLILMLTLRTFNLCCGVMIIKL

SEQ ID NO: 3601 - protein, 24 aa, Corononavirus-HKU1
LFILKCKLLVTGNLVILCLFYISI

SEQ ID NO: 3602 - protein, 18 aa, Corononavirus-HKU1
REFLYGIMVKLLIYQQVV

SEQ ID NO: 3603 - protein, 11 aa, Corononavirus-HKU1
MLLSILNYVSI

SEQ ID NO: 3604 - protein, 4 aa, Corononavirus-HKU1
ILQH

SEQ ID NO: 3605 - protein, 10 aa, Corononavirus-HKU1
LFLLICVSYT

SEQ ID NO: 3606 - protein, 7 aa, Corononavirus-HKU1
VQDLIKK

SEQ ID NO: 3607 - protein, 6 aa, Corononavirus-HKU1
PLVLLF

SEQ ID NO: 3608 - protein, 10 aa, Corononavirus-HKU1
DSGYHLVVFL

SEQ ID NO: 3609 - protein, 7 aa, Corononavirus-HKU1
ILLLVIV

SEQ ID NO: 3610 - protein, 7 aa, Corononavirus-HKU1
SLILEIV

SEQ ID NO: 3611 - protein, 9 aa, Corononavirus-HKU1
LYHLIVIGI

SEQ ID NO: 3612 - protein, 16 aa, Corononavirus-HKU1
YLICMILLLRILVIIM

SEQ ID NO: 3613 - protein, 11 aa, Corononavirus-HKU1
VRMVSLLIFVI

SEQ ID NO: 3614 - protein, 12 aa, Corononavirus-HKU1
FVINYLWVVVLL

SEQ ID NO: 3615 - protein, 13 aa, Corononavirus-HKU1
KLQNFLGMLTYIN

SEQ ID NO: 3616 - protein, 12 aa, Corononavirus-HKU1
VILHSGQFFVLM

SEQ ID NO: 3617 - protein, 8 aa, Corononavirus-HKU1
MLLLVKGF

SEQ ID NO: 3618 - protein, 9 aa, Corononavirus-HKU1
IIWVSPALK

SEQ ID NO: 3619 - protein, 32 aa, Corononavirus-HKU1
MAMLCMPTICFGEIVQHGMVVLIVYLICLNFL

SEQ ID NO: 3620 - protein, 6 aa, Corononavirus-HKU1
NWLALL

SEQ ID NO: 3621 - protein, 4 aa, Corononavirus-HKU1
DQIN

SEQ ID NO: 3622 - protein, 10 aa, Corononavirus-HKU1
FILLLKEVSY

SEQ ID NO: 3623 - protein, 14 aa, Corononavirus-HKU1
CVIRVKKFLLVIVL

SEQ ID NO: 3624 - protein, 22 aa, Corononavirus-HKU1
TLVRSFSLLILNLNYVNYIFIF

SEQ ID NO: 3625 - protein, 5 aa, Corononavirus-HKU1
FLLWF

SEQ ID NO: 3626 - protein, 10 aa, Corononavirus-HKU1
TFECCVSFKP

SEQ ID NO: 3627 - protein, 5 aa, Corononavirus-HKU1
LVFIW

SEQ ID NO: 3628 - protein, 9 aa, Corononavirus-HKU1
KLWLFGYSP

SEQ ID NO: 3629 - protein, 8 aa, Corononavirus-HKU1
ELSFYPVL

SEQ ID NO: 3630 - protein, 5 aa, Corononavirus-HKU1
LHWRG

SEQ ID NO: 3631 - protein, 5 aa, Corononavirus-HKU1
SNYFL

SEQ ID NO: 3632 - protein, 5 aa, Corononavirus-HKU1
FQSSS

SEQ ID NO: 3633 - protein, 4 aa, Corononavirus-HKU1
CMDF

SEQ ID NO: 3634 - protein, 10 aa, Corononavirus-HKU1
QGEVLSCFIF

SEQ ID NO: 3635 - protein, 10 aa, Corononavirus-HKU1
YGSFSLSYLC

SEQ ID NO: 3636 - protein, 9 aa, Corononavirus-HKU1
YSLQFFFFY

SEQ ID NO: 3637 - protein, 4 aa, Corononavirus-HKU1
YFIT

SEQ ID NO: 3638 - protein, 4 aa, Corononavirus-HKU1
SYFY

SEQ ID NO: 3639 - protein, 19 aa, Corononavirus-HKU1
GRLFHFIRVFFVFSTSLSF

SEQ ID NO: 3640 - protein, 4 aa, Corononavirus-HKU1
SVLL

SEQ ID NO: 3641 - protein, 10 aa, Corononavirus-HKU1
YGYWLCLWLF

SEQ ID NO: 3642 - protein, 4 aa, Corononavirus-HKU1
FCFF

SEQ ID NO: 3643 - protein, 8 aa, Corononavirus-HKU1
FRLYIYFS

SEQ ID NO: 3644 - protein, 4 aa, Corononavirus-HKU1
TWFL

SEQ ID NO: 3645 - protein, 12 aa, Corononavirus-HKU1
NFFYWFCFIHTY

SEQ ID NO: 3646 - protein, 4 aa, Corononavirus-HKU1
SSLL

SEQ ID NO: 3647 - protein, 8 aa, Corononavirus-HKU1
TICTRAGC

SEQ ID NO: 3648 - protein, 27 aa, Corononavirus-HKU1
VEQSSCIGYFIIRCMSVALLLFSQFFW

SEQ ID NO: 3649 - protein, 5 aa, Corononavirus-HKU1
LCWQI

SEQ ID NO: 3650 - protein, 11 aa, Corononavirus-HKU1
WFYFYSIWSFI

SEQ ID NO: 3651 - protein, 12 aa, Corononavirus-HKU1
CLLYFLLWLLFV

SEQ ID NO: 3652 - protein, 12 aa, Corononavirus-HKU1
QFYINLASFFFW

SEQ ID NO: 3653 - protein, 7 aa, Corononavirus-HKU1
LSYICLY

SEQ ID NO: 3654 - protein, 5 aa, Corononavirus-HKU1
IKLFL

SEQ ID NO: 3655 - protein, 1385 aa, Corononavirus-HKU1
SFAYYFTRYFIIFSFIVYCVFTFSSLPWLILNLNMFLIIFILPTTLAVIGDFNCTNSFINDYNKTIPRISEDVVDVSLGLGTYYVLNRVYLNTTLLFTGYFPKSGANFRDLALKGSKYLSTLWYKPPFLSDFNNGIFSKVKNTKLYVNNTLYSEFSTIVIGSVFVNTSYTIVVQPHNGILEITACQYTMCEYPHTVCKSKGSIRNESWHIDSSEPLCLFKKNFTYNVSADWLYFHFYQERGVFYAYYADVGMPTTFLFSLYLGTILSHYYVMPLTCKAISSNTDNETLEYWVTPLSRRQYLLNFDEHGVITNAVDCSSSFLSEIQCKTQSFAPNTGVYDLSGFTVKPVATVYRRIPNLPDCDIDNWLNNVSVPSPLNWERRIFSNCNFNLSTLLRLVHVDSFSCNNLDKSKIFGSCFNSITVDKFAIPNRRRDDLQLGSSGFLQSSNYKIDISSSSCQLYYSLPLVNVTINNFNPSSWNRRYGFGSFNVSSYDVVYSDHCFSVNSDFCPCADPSVVNSCVKSKPLSAICPAGTKYRHCDLDTTLYVNNWCRCSCLPDPISTYSPNTCPQKKVVVGIGEHCPGLGINEEKCGTQLNHSSCSCSPDAFLGWSFDSCISNNRCNIFSNFIFNGINSGTTCSNDLLYSNTEVSTGVCVNYDLYGITGQGIFKEVSAAYYNNWQNLLYDSNGNIIGFKDFLTNKTYTILPCYSGRVSAAFYQNSSSPALLYRNLKCSYVLNNISFISQPFYFDSYLGCVLNAVNLTSYSVSSCDLRMGSGFCIDYALPSSRRKRRGISSPYRFVTFEPFNVSFVNDSVETVGGLFEIQIPTNFTIAGHEEFIQTSSPKVTIDCSAFVCSNYAACHDLLSEYGTFCDNINSILNEVNDLLDITQLQVANALMQGVTLSSNLNTNLHSDVDNIDFKSLLGCLGSQCGSSSRSLLEDLLFNKVKLSDVGFVEAYNNCTGGSEIRDLLCVQSFNGIKVLPPILSETQISGYTTAATVAAMFPPWSAAAGVPFSLNVQYRINGLGVTMDVLNKNQKLIANAFNKALLSIQNGFTATNSALAKIQSVVNANAQALNSLLQQLFNKFGAISSSLQEILSRLDNLEAQVQIDRLINGRLTALNAYVSQQLSDITLIKAGASRAIEKVNECVKSQSPRINFCGNGNHILSLVQNAPYGLLFIHFSYKPTSFKTVLVSPGLCLSGDRGIAPKQGYFIKQNDSWMFTGSSYYYPEPISDKNVVFMNSCSVNFTKAPFIYLNNSIPNLSDFEAEFSLWFKNHTSIAPNLTFNSHINATFLDLYYEMNVIQESIKSLNSSFINLKEIGTYEMYVKWPWYIWLLIVILFIIFLMILFFICCCTGCGSACFSKCHNCCDEYGGHNDFVIKASHDD

SEQ ID NO: 3656 - protein, 13 aa, Corononavirus-HKU1
ILNLNFIYGSLEA

SEQ ID NO: 3657 - protein, 5 aa, Corononavirus-HKU1
IFSYY

SEQ ID NO: 3658 - protein, 7 aa, Corononavirus-HKU1
RIWCHRS

SEQ ID NO: 3659 - protein, 4 aa, Corononavirus-HKU1
GFVF

SEQ ID NO: 3660 - protein, 18 aa, Corononavirus-HKU1
LLPTLCWLLYCTFKRLVS

SEQ ID NO: 3661 - protein, 8 aa, Corononavirus-HKU1
ICFLFCFT

SEQ ID NO: 3662 - protein, 5 aa, Corononavirus-HKU1
FWCYN

SEQ ID NO: 3663 - protein, 6 aa, Corononavirus-HKU1
FYRLAS

SEQ ID NO: 3664 - protein, 13 aa, Corononavirus-HKU1
VWLMYFSLILLGM

SEQ ID NO: 3665 - protein, 5 aa, Corononavirus-HKU1
VRFSF

SEQ ID NO: 3666 - protein, 7 aa, Corononavirus-HKU1
FYLVSFS

SEQ ID NO: 3667 - protein, 6 aa, Corononavirus-HKU1
FLLLHF

SEQ ID NO: 3668 - protein, 43 aa, Corononavirus-HKU1
QLLNFVFKFVVFVIFLLFHLLPMFIIEVDSCISLIVNMSYLLL

SEQ ID NO: 3669 - protein, 7 aa, Corononavirus-HKU1
FKSKHHE

SEQ ID NO: 3670 - protein, 8 aa, Corononavirus-HKU1
INFSSLEF

SEQ ID NO: 3671 - protein, 31 aa, Corononavirus-HKU1
SSYYILKRMEFLFGCNITSHYYHTAVWLYES

SEQ ID NO: 3672 - protein, 6 aa, Corononavirus-HKU1
YVCLSY

SEQ ID NO: 3673 - protein, 17 aa, Corononavirus-HKU1
DDYSLAYVAIDHYLDYI

SEQ ID NO: 3674 - protein, 6 aa, Corononavirus-HKU1
LLLCFE

SEQ ID NO: 3675 - protein, 37 aa, Corononavirus-HKU1
YLSWAFYTVYYYFYCYMDFIFCQQYSAFYQNWQLVEF

SEQ ID NO: 3676 - protein, 4 aa, Corononavirus-HKU1
SYVY

SEQ ID NO: 3677 - protein, 19 aa, Corononavirus-HKU1
GLSYINGYCYPWSSLYTGC

SEQ ID NO: 3678 - protein, 17 aa, Corononavirus-HKU1
TWHWLHACRFACLCYCS

SEQ ID NO: 3679 - protein, 7 aa, Corononavirus-HKU1
GASPLYL

SEQ ID NO: 3680 - protein, 5 aa, Corononavirus-HKU1
TCLFR

SEQ ID NO: 3681 - protein, 6 aa, Corononavirus-HKU1
WFCCFC

SEQ ID NO: 3682 - protein, 5 aa, Corononavirus-HKU1
LSFTF

SEQ ID NO: 3683 - protein, 14 aa, Corononavirus-HKU1
WYGYCLVESLNLNY

SEQ ID NO: 3684 - protein, 11 aa, Corononavirus-HKU1
DVLYSRSSCWK

SEQ ID NO: 3685 - protein, 16 aa, Corononavirus-HKU1
KLLWKSFRNPQENFLG

SEQ ID NO: 3686 - protein, 6 aa, Corononavirus-HKU1
AKPSNL

SEQ ID NO: 3687 - protein, 34 aa, Corononavirus-HKU1
RQKTPTQIHCVYSTTRKPYPTLFLVLWDYPISKR

SEQ ID NO: 3688 - protein, 16 aa, Corononavirus-HKU1
ISRWSRSTHCLRDTPF

SEQ ID NO: 3689 - protein, 6 aa, Corononavirus-HKU1
SKRILV

SEQ ID NO: 3690 - protein, 6 aa, Corononavirus-HKU1
TQPAFF

SEQ ID NO: 3691 - protein, 26 aa, Corononavirus-HKU1
WSTKAVVTKMVFLLSRYRSICQFILW

SEQ ID NO: 3692 - protein, 9 aa, Corononavirus-HKU1
CPRRYLLGR

SEQ ID NO: 3693 - protein, 20 aa, Corononavirus-HKU1
HFYSLRCFGKGSYYSRSYPY

SEQ ID NO: 3694 - protein, 13 aa, Corononavirus-HKU1
VFAWYDFASRLLC

SEQ ID NO: 3695 - protein, 7 aa, Corononavirus-HKU1
RLRKVCF

SEQ ID NO: 3696 - protein, 12 aa, Corononavirus-HKU1
PARFTFSITWTQ

SEQ ID NO: 3697 - protein, 4 aa, Corononavirus-HKU1
SFIK

SEQ ID NO: 3698 - protein, 5 aa, Corononavirus-HKU1
FYSET

SEQ ID NO: 3699 - protein, 7 aa, Corononavirus-HKU1
SCLGQAW

SEQ ID NO: 3700 - protein, 9 aa, Corononavirus-HKU1
TSASYQAKC

SEQ ID NO: 3701 - protein, 11 aa, Corononavirus-HKU1
NFNETSPKANS

SEQ ID NO: 3702 - protein, 6 aa, Corononavirus-HKU1
CSTVFW

SEQ ID NO: 3703 - protein, 8 aa, Corononavirus-HKU1
KRTAPKLW

SEQ ID NO: 3704 - protein, 6 aa, Corononavirus-HKU1
NVKAWY

SEQ ID NO: 3705 - protein, 7 aa, Corononavirus-HKU1
SSISYSC

SEQ ID NO: 3706 - protein, 12 aa, Corononavirus-HKU1
ISPYTRCFFLWL

SEQ ID NO: 3707 - protein, 4 aa, Corononavirus-HKU1
IRVV

SEQ ID NO: 3708 - protein, 7 aa, Corononavirus-HKU1
TSLFWFY

SEQ ID NO: 3709 - protein, 5 aa, Corononavirus-HKU1
YFTWF

SEQ ID NO: 3710 - protein, 6 aa, Corononavirus-HKU1
DNYESS

SEQ ID NO: 3711 - protein, 7 aa, Corononavirus-HKU1
REFRCLC

SEQ ID NO: 3712 - protein, 10 aa, Corononavirus-HKU1
SEHCFWFAES

SEQ ID NO: 3713 - protein, 6 aa, Corononavirus-HKU1
YSAHFK

SEQ ID NO: 3714 - protein, 5 aa, Corononavirus-HKU1
FTCYS

SEQ ID NO: 3715 - protein, 34 aa, Corononavirus-HKU1
  misc_feature (1)..(1): The 'Xaa' at location 1 stands for Tyr, Cys, Ser, or Phe.
XLCRRLCCLMRMNPNSTLGGNPSLLVGIGHSLSE

SEQ ID NO: 3716 - protein, 17 aa, Corononavirus-HKU1
ILAVTTDRVGCCRLYIN

SEQ ID NO: 3717 - protein, 4 aa, Corononavirus-HKU1
KLYI

SEQ ID NO: 3718 - protein, 4 aa, Corononavirus-HKU1
IFDC

SEQ ID NO: 3719 - protein, 5 aa, Corononavirus-HKU1
SSYKV

SEQ ID NO: 3720 - protein, 19 aa, Corononavirus-HKU1
YKRLREELAIIVFNIYISI

SEQ ID NO: 3721 - protein, 16 aa, Corononavirus-HKU1
LKLIIAFWRNYKKKKK

SEQ ID NO: 3722 - DNA, 29836 bp, Corononavirus-HKU1; identical to SEQ ID NO: 2919
  CDS (3)..(29834)
  modified_base (29514): a, c, g, t, unknown or other

SEQ ID NO: 3723 - protein, 34 aa, Corononavirus-HKU1; identical to SEQ ID NO: 725

SEQ ID NO: 3724 - protein, 19 aa, Corononavirus-HKU1
VWFNHNLVFYFPHFSSLCQ

SEQ ID NO: 3725 - protein, 13 aa, Corononavirus-HKU1
RVGCPQRPSHRSQ

SEQ ID NO: 3726 - protein, 30 aa, Corononavirus-HKU1; identical to SEQ ID NO: 728

SEQ ID NO: 3727 - protein, 25 aa, Corononavirus-HKU1
SQMRVGYAPLLVKRWKVLDLFMIIM

SEQ ID NO: 3728 - protein, 28 aa, Corononavirus-HKU1
IVAAFLDKNGMCSQILSVIFLFMKIYML

SEQ ID NO: 3729 - protein, 4 aa, Corononavirus-HKU1
LKQP

SEQ ID NO: 3730 - protein, 6 aa, Corononavirus-HKU1
SPVRQF

SEQ ID NO: 3731 - protein, 34 aa, Corononavirus-HKU1; identical to SEQ ID NO: 733

SEQ ID NO: 3732 - protein, 40 aa, Corononavirus-HKU1; identical to SEQ ID NO: 734

SEQ ID NO: 3733 - protein, 12 aa, Corononavirus-HKU1
FQILNLMIMILV

SEQ ID NO: 3734 - protein, 34 aa, Corononavirus-HKU1
KMLMLRFMLSLKVNIHKKLMLYLDNIVVLNPYSL

SEQ ID NO: 3735 - protein, 10 aa, Corononavirus-HKU1
TSMVVTILVN

SEQ ID NO: 3736 - protein, 14 aa, Corononavirus-HKU1
QIVFKLMVIILCKI

SEQ ID NO: 3737 - protein, 15 aa, Corononavirus-HKU1
DKSSLYGLPIATLIL

SEQ ID NO: 3738 - protein, 4 aa, Corononavirus-HKU1
WLGM

SEQ ID NO: 3739 - protein, 12 aa, Corononavirus-HKU1
FVIHDLLCACRL

SEQ ID NO: 3740 - protein, 15 aa, Corononavirus-HKU1
LLFVVLNMLHNLQKM

SEQ ID NO: 3741 - protein, 13 aa, Corononavirus-HKU1
LYVNLYIYYLLMQ

SEQ ID NO: 3742 - protein, 4 aa, Corononavirus-HKU1
SFLV

SEQ ID NO: 3743 - protein, 27 aa, Corononavirus-HKU1
LIWMIFLLNLYTMLICVIVVLLCSMVM

SEQ ID NO: 3744 - protein, 16 aa, Corononavirus-HKU1
IVLMIIVIFMVGFQVI

SEQ ID NO: 3745 - protein, 86 aa, Corononavirus-HKU1
WMVFLVHCVVQFMTLVKLKPNHLVLFLRILCYLLIVLILLTLILLICMVILLHHLVLVYIGHRVLDCGFLSLNLQSSLMMIWFIQV

SEQ ID NO: 3746 - protein, 17 aa, Corononavirus-HKU1
VVNLLLKKLLLLLMHFT

SEQ ID NO: 3747 - protein, 36 aa, Corononavirus-HKU1
IMFNVSVVILNKIIFLVLIILGVGNCCLIEVIIICF

SEQ ID NO: 3748 - protein, 28 aa, Corononavirus-HKU1
KILTCLLSVVLILLASLQFVEMVLYLFY

SEQ ID NO: 3749 - protein, 6 aa, Corononavirus-HKU1
FPVVII

SEQ ID NO: 3750 - protein, 9 aa, Corononavirus-HKU1
FRVVFSLHL

SEQ ID NO: 3751 - protein, 12 aa, Corononavirus-HKU1
CLNFHKKFLICV

SEQ ID NO: 3752 - protein, 16 aa, Corononavirus-HKU1
KCVFCLWTEFQLLHFI

SEQ ID NO: 3753 - protein, 29 aa, Corononavirus-HKU1
SIMLIGWLLNLSYWVLHLLIKWLIGLIPC

SEQ ID NO: 3754 - protein, 14 aa, Corononavirus-HKU1
MLVHLLQAGFFTNY

SEQ ID NO: 3755 - protein, 4 aa, Corononavirus-HKU1
MVFL

SEQ ID NO: 3756 - protein, 10 aa, Corononavirus-HKU1
YLKPTLILLL

SEQ ID NO: 3757 - protein, 7 aa, Corononavirus-HKU1
YLIMLKF

SEQ ID NO: 3758 - protein, 11 aa, Corononavirus-HKU1
LINFTLFLSYY

SEQ ID NO: 3759 - protein, 7 aa, Corononavirus-HKU1
SVLQLMF

SEQ ID NO: 3760 - protein, 11 aa, Corononavirus-HKU1
KICLFLKLLMV

SEQ ID NO: 3761 - protein, 10 aa, Corononavirus-HKU1
AISFITLVQG

SEQ ID NO: 3762 - protein, 25 aa, Corononavirus-HKU1
FLVLFYHVMHRNNKFIFLKALQNLL

SEQ ID NO: 3763 - protein, 23 aa, Corononavirus-HKU1
KMMLLRMSNLLYHLMSIVNHLNL

SEQ ID NO: 3764 - protein, 5 aa, Corononavirus-HKU1
KKFVL

SEQ ID NO: 3765 - protein, 16 aa, Corononavirus-HKU1
IICTWVSVVINFSLLS

SEQ ID NO: 3766 - protein, 7 aa, Corononavirus-HKU1
MIKIFVF

SEQ ID NO: 3767 - protein, 26 aa, Corononavirus-HKU1
IRLGVFHVQVEKLILTRNLLLWRFRL

SEQ ID NO: 3768 - protein, 7 aa, Corononavirus-HKU1
QLRLCLI

SEQ ID NO: 3769 - protein, 7 aa, Corononavirus-HKU1
ILLLMIF

SEQ ID NO: 3770 - protein, 8 aa, Corononavirus-HKU1
VKFVQNLK

SEQ ID NO: 3771 - protein, 5 aa, Corononavirus-HKU1
KRVLL

SEQ ID NO: 3772 - protein, 10 aa, Corononavirus-HKU1
MILSLLFVML

SEQ ID NO: 3773 - protein, 16 aa, Corononavirus-HKU1
TLVKIIQWLVIKFVHF

SEQ ID NO: 3774 - protein, 184 aa, Corononavirus-HKU1
INLMRTLFIYLMRLVMKQWPLVCIVLLLLRMLKTLSVVKLLKILLMVSLKTLLMMMKMLLLVTMTMKMLLLVTMTMKMLLLVTMTMKMLLLVTMTMKMLLLVIMTMKMLLLVTMTMKMLLLVTMTMKMLLLVTMTMKMLLLVTMTMKMLLLVTMTMKMLLLVTMTMKRLLLVTMMTKLLLLVMM

SEQ ID NO: 3775 - protein, 15 aa, Corononavirus-HKU1
MILKVSMILILIKLF

SEQ ID NO: 3776 - protein, 46 aa, Corononavirus-HKU1
FLMMSIMMLCLLVMVLVLKQKHILKLMVYGHLLLHILTVGCVLCYL

SEQ ID NO: 3777 - protein, 10 aa, Corononavirus-HKU1
CRNYLLSLRI

SEQ ID NO: 3778 - protein, 21 aa, Corononavirus-HKU1
LLKICGYLIRWVIIKVLLIIY

SEQ ID NO: 3779 - protein, 14 aa, Corononavirus-HKU1
PLFLKLLFCLKVVM

SEQ ID NO: 3780 - protein, 7 aa, Corononavirus-HKU1
LTLLIGF

SEQ ID NO: 3781 - protein, 13 aa, Corononavirus-HKU1
TSLILMRMLIGVV

SEQ ID NO: 3782 - protein, 7 aa, Corononavirus-HKU1
NVVFLLI

SEQ ID NO: 3783 - protein, 22 aa, Corononavirus-HKU1
MVWMLCFFMEILCLMFVSVDII

SEQ ID NO: 3784 - protein, 34 aa, Corononavirus-HKU1; identical to SEQ ID NO: 787

SEQ ID NO: 3785 - protein, 5 aa, Corononavirus-HKU1
TFVIL

SEQ ID NO: 3786 - protein, 4 aa, Corononavirus-HKU1
VMNK

SEQ ID NO: 3787 - protein, 15 aa, Corononavirus-HKU1
MVSLLLNLVVINLIL

SEQ ID NO: 3788 - protein, 12 aa, Corononavirus-HKU1
VMECHLVCLLLS

SEQ ID NO: 3789 - protein, 7 aa, Corononavirus-HKU1
LNCMVCV

SEQ ID NO: 3790 - protein, 11 aa, Corononavirus-HKU1
HLMYVLLKVIL

SEQ ID NO: 3791 - protein, 28 aa, Corononavirus-HKU1
MLLDLLKLMLLLTLLMGICSMVVELQKL

SEQ ID NO: 3792 - protein, 21 aa, Corononavirus-HKU1
LQVKNFLKKLLLWLNLKVFAK

SEQ ID NO: 3793 - protein, 18 aa, Corononavirus-HKU1
EIVMFLPVVNYVKQFLIL

SEQ ID NO: 3794 - protein, 14 aa, Corononavirus-HKU1
VLMLDKMEDNLMFC

SEQ ID NO: 3795 - protein, 30 aa, Corononavirus-HKU1; identical to SEQ ID NO: 797

SEQ ID NO: 3796 - protein, 37 aa, Corononavirus-HKU1; identical to SEQ ID NO: 798

SEQ ID NO: 3797 - protein, 14 aa, Corononavirus-HKU1
AVLLNLRQMHTNFS

SEQ ID NO: 3798 - protein, 24 aa, Corononavirus-HKU1
VVMIVLFQILLLYKKFYCFVMIYN

SEQ ID NO: 3799 - protein, 11 aa, Corononavirus-HKU1
IMTFVIICCLR

SEQ ID NO: 3800 - protein, 59 aa, Corononavirus-HKU1
LVFPKIGVLSINLMLLTVLKLLSTLSVLILFIYVVRVKTLVMYVMVLFIKQLLIKFVCY

SEQ ID NO: 3801 - protein, 5 aa, Corononavirus-HKU1
MFCLL

SEQ ID NO: 3802 - protein, 11 aa, Corononavirus-HKU1
MVLILNLFLLL

SEQ ID NO: 3803 - protein, 20 aa, Corononavirus-HKU1
VKFLVKYLVMFSVMALMLLS

SEQ ID NO: 3804 - protein, 18 aa, Corononavirus-HKU1
SVVIFMPIKFYISMKICL

SEQ ID NO: 3805 - protein, 23 aa, Corononavirus-HKU1
LIFLLYKVHLGLISNNCLLTIIF

SEQ ID NO: 3806 - protein, 6 aa, Corononavirus-HKU1
QYVNGL

SEQ ID NO: 3807 - protein, 17 aa, Corononavirus-HKU1
LLTVHFFLLNSLIIIVM

SEQ ID NO: 3808 - protein, 31 aa, Corononavirus-HKU1; identical to SEQ ID NO: 810

SEQ ID NO: 3809 - protein, 4 aa, Corononavirus-HKU1
LLLF

SEQ ID NO: 3810 - protein, 20 aa, Corononavirus-HKU1
LKVILNLMNHQMLLILFVLF

SEQ ID NO: 3811 - protein, 11 aa, Corononavirus-HKU1
NKLIYQVQFVN

SEQ ID NO: 3812 - protein, 24 aa, Corononavirus-HKU1
NLFVIVVLNKKVVLVLMLLCILVH

SEQ ID NO: 3813 - protein, 24 aa, Corononavirus-HKU1
QRLIFLMVIRLAVIVQVELSIVLN

SEQ ID NO: 3814 - protein, 4 aa, Corononavirus-HKU1
MYHF

SEQ ID NO: 3815 - protein, 6 aa, Corononavirus-HKU1
FVLILL

SEQ ID NO: 3816 - protein, 16 aa, Corononavirus-HKU1
VRIYLMMLLQLTCLWV

SEQ ID NO: 3817 - protein, 5 aa, Corononavirus-HKU1
AIIHI

SEQ ID NO: 3818 - protein, 23 aa, Corononavirus-HKU1
NVVHLTNIMMLVVLKNIQVLVVV

SEQ ID NO: 3819 - protein, 8 aa, Corononavirus-HKU1
LTACILKI

SEQ ID NO: 3820 - protein, 7 aa, Corononavirus-HKU1
PRLLHLC

SEQ ID NO: 3821 - protein, 32 aa, Corononavirus-HKU1; identical to SEQ ID NO: 823

SEQ ID NO: 3822 - protein, 18 aa, Corononavirus-HKU1
RLSLNHLLKLTVFILTLS

SEQ ID NO: 3823 - protein, 8 aa, Corononavirus-HKU1
LDMIFVLN

SEQ ID NO: 3824 - protein, 8 aa, Corononavirus-HKU1
ICRLLSTK

SEQ ID NO: 3825 - protein, 4 aa, Corononavirus-HKU1
QSGL

SEQ ID NO: 3826 - protein, 37 aa, Corononavirus-HKU1
LLVMLFWHLMIYMLNVILKDVKLLVSLLFGFVMMKHH

SEQ ID NO: 3827 - protein, 48 aa, Corononavirus-HKU1; identical to SEQ ID NO: 830

SEQ ID NO: 3828 - protein, 8 aa, Corononavirus-HKU1
RVLERLLK

SEQ ID NO: 3829 - protein, 20 aa, Corononavirus-HKU1
KMLLLLMMKIVLLRLLKVYL

SEQ ID NO: 3830 - protein, 7 aa, Corononavirus-HKU1
LMFGICI

SEQ ID NO: 3831 - protein, 15 aa, Corononavirus-HKU1
QVVIMLFGLLMNCHA

SEQ ID NO: 3832 - protein, 20 aa, Corononavirus-HKU1
LNHQQLGNIYDMVLNLLLYL

SEQ ID NO: 3833 - protein, 4 aa, Corononavirus-HKU1
ICYV

SEQ ID NO: 3834 - protein, 7 aa, Corononavirus-HKU1
EMIIKLF

SEQ ID NO: 3835 - protein, 9 aa, Corononavirus-HKU1
FLKFLKQEL

SEQ ID NO: 3836 - protein, 5 aa, Corononavirus-HKU1
NFMVF

SEQ ID NO: 3837 - protein, 24 aa, Corononavirus-HKU1
SGCLFMFLVYYILQMIKPFFILQK

SEQ ID NO: 3838 - protein, 25 aa, Corononavirus-HKU1
LLSLLLICFVWLLKMLFRHLDGVYL

SEQ ID NO: 3839 - protein, 5 aa, Corononavirus-HKU1
KVFLL

SEQ ID NO: 3840 - protein, 12 aa, Corononavirus-HKU1
PLCFCFGLIFCI

SEQ ID NO: 3841 - protein, 25 aa, Corononavirus-HKU1
MLFLVIFIFLILVFFLFLWEELLCG

SEQ ID NO: 3842 - protein, 15 aa, Corononavirus-HKU1
RLLLVWLQFVIFILS

SEQ ID NO: 3843 - protein, 28 aa, Corononavirus-HKU1
VLQVIFVMVVLYVNCVILVLICWIHMQL

SEQ ID NO: 3844 - protein, 6 aa, Corononavirus-HKU1
ILFSMK

SEQ ID NO: 3845 - protein, 10 aa, Corononavirus-HKU1
IDVFYLIMLV

SEQ ID NO: 3846 - protein, 36 aa, Corononavirus-HKU1
LLNSLLVIHYIQYGFIHYFVLLVYNYLLHGCLICLC

SEQ ID NO: 3847 - protein, 5 aa, Corononavirus-HKU1
KLCIG

SEQ ID NO: 3848 - protein, 6 aa, Corononavirus-HKU1
LDLLYL

SEQ ID NO: 3849 - protein, 13 aa, Corononavirus-HKU1
LICYLLLSCCGFI

SEQ ID NO: 3850 - protein, 7 aa, Corononavirus-HKU1
LLLLCIK

SEQ ID NO: 3851 - protein, 36 aa, Corononavirus-HKU1
LVLLGILFMVVIKLVVCFVINEIVVFVLSVVLLLVV

SEQ ID NO: 3852 - protein, 34 aa, Corononavirus-HKU1; identical to SEQ ID NO: 855

SEQ ID NO: 3853 - protein, 9 aa, Corononavirus-HKU1
NFLKSLNDL

SEQ ID NO: 3854 - protein, 8 aa, Corononavirus-HKU1
TQLMLHIM

SEQ ID NO: 3855 - protein, 9 aa, Corononavirus-HKU1
LLILSKLVV

SEQ ID NO: 3856 - protein, 21 aa, Corononavirus-HKU1
CVCSMIEMDSVFTMMLMLVYL

SEQ ID NO: 3857 - protein, 17 aa, Corononavirus-HKU1
ILIICYILKSKLFLICM

SEQ ID NO: 3858 - protein, 9 aa, Corononavirus-HKU1
RVMLIELIF

SEQ ID NO: 3859 - protein, 16 aa, Corononavirus-HKU1
MLLCFMHNHCIGLYYL

SEQ ID NO: 3860 - protein, 9 aa, Corononavirus-HKU1
LLQLVMVSL

SEQ ID NO: 3861 - protein, 39 aa, Corononavirus-HKU1; identical to SEQ ID NO: 864

SEQ ID NO: 3862 - protein, 25 aa, Corononavirus-HKU1
ILLWDVYVNVVPLIQMLKQDLLLNL

SEQ ID NO: 3863 - protein, 18 aa, Corononavirus-HKU1
LLVWNLLMKIITIWYLHI

SEQ ID NO: 3864 - protein, 5 aa, Corononavirus-HKU1
RVIIL

SEQ ID NO: 3865 - protein, 40 aa, Corononavirus-HKU1
VFLYRMVLSMYRVMLLRQLIFLVYGLLTLLINLLLIYSIN

SEQ ID NO: 3866 - protein, 8 aa, Corononavirus-HKU1
KKHVLKLA

SEQ ID NO: 3867 - protein, 23 aa, Corononavirus-HKU1
LLISKRQVFLFLQRPFHLKEVLY

SEQ ID NO: 3868 - protein, 11 aa, Corononavirus-HKU1
VICYIYYFLLV

SEQ ID NO: 3869 - protein, 94 aa, Corononavirus-HKU1
SVLYYCGLYCLHIVFISLIFICLLMLVLKLLIMVLLEIFQLMIYVLLINFSNLINGMSPLLGLFTIIILWIALLLWQLWMKILVLLCLMFLLKF

SEQ ID NO: 3870 - protein, 9 aa, Corononavirus-HKU1
DMAFMFYIF

SEQ ID NO: 3871 - protein, 53 aa, Corononavirus-HKU1; identical to SEQ ID NO: 875

SEQ ID NO: 3872 - protein, 23 aa, Corononavirus-HKU1
RMLLCIHLWFHIHVIALLILMVL

SEQ ID NO: 3873 - protein, 13 aa, Corononavirus-HKU1
DFLMLLVKVLYVL

SEQ ID NO: 3874 - protein, 4 aa, Corononavirus-HKU1
ERAL

SEQ ID NO: 3875 - protein, 24 aa, Corononavirus-HKU1
LIVEWVHVNMPKRVYVLILIVPGF

SEQ ID NO: 3876 - protein, 27 aa, Corononavirus-HKU1
IMIIIEVCLELFVVEIFLICFINFLVV

SEQ ID NO: 3877 - protein, 16 aa, Corononavirus-HKU1
ISFLLLLVLFLELYWL

SEQ ID NO: 3878 - protein, 8 aa, Corononavirus-HKU1
SLSWFFII

SEQ ID NO: 3879 - protein, 12 aa, Corononavirus-HKU1
NLSVLLEIILVL

SEQ ID NO: 3880 - protein, 31 aa, Corononavirus-HKU1
MLLFGVLIFLCFLFFKFILFVHVSMLVFIFM

SEQ ID NO: 3881 - protein, 9 aa, Corononavirus-HKU1
HCIFLLKLV

SEQ ID NO: 3882 - protein, 12 aa, Corononavirus-HKU1
LCICNGLLCMVL

SEQ ID NO: 3883 - protein, 9 aa, Corononavirus-HKU1
CLFGFVSHM

SEQ ID NO: 3884 - protein, 36 aa, Corononavirus-HKU1
LWLLQTMFYGYFHIVGKLVLMYVMIVHLKKHLLLLL

SEQ ID NO: 3885 - protein, 8 aa, Corononavirus-HKU1
LLKILIVD

SEQ ID NO: 3886 - protein, 12 aa, Corononavirus-HKU1
RILFLMLLTIDI

SEQ ID NO: 3887 - protein, 25 aa, Corononavirus-HKU1
VCIISIVTIVVKWILLPIEKRRVLS

SEQ ID NO: 3888 - protein, 33 aa, Corononavirus-HKU1; identical to SEQ ID NO: 892

SEQ ID NO: 3889 - protein, 20 aa, Corononavirus-HKU1
RWYLLRQKLNLVLLVLLMVV

SEQ ID NO: 3890 - protein, 4 aa, Corononavirus-HKU1
MVYG

SEQ ID NO: 3891 - protein, 16 aa, Corononavirus-HKU1
MTKFIVLVMLYVYPLI

SEQ ID NO: 3892 - protein, 13 aa, Corononavirus-HKU1
MNLIILPYYVELL

SEQ ID NO: 3893 - protein, 4 aa, Corononavirus-HKU1
VILL

SEQ ID NO: 3894 - protein, 4 aa, Corononavirus-HKU1
CLGG

SEQ ID NO: 3895 - protein, 13 aa, Corononavirus-HKU1
QLCLTRCRAVNLF

SEQ ID NO: 3896 - protein, 25 aa, Corononavirus-HKU1
QSLYKILTLQNILLVLLNLVKLLLF

SEQ ID NO: 3897 - protein, 36 aa, Corononavirus-HKU1; identical to SEQ ID NO: 901

SEQ ID NO: 3898 - protein, 12 aa, Corononavirus-HKU1
QVIVLSLYICIN

SEQ ID NO: 3899 - protein, 69 aa, Corononavirus-HKU1
SSVLVVTLALILLVIFMVHIEMLKLYSCQLRTTSKLLMLLLGSMQLYLIIVLGLYKMMFVLLKILMFGL

SEQ ID NO: 3900 - protein, 6 aa, Corononavirus-HKU1
QMVLAK

SEQ ID NO: 3901 - protein, 5 aa, Corononavirus-HKU1
KQILF

SEQ ID NO: 3902 - protein, 5 aa, Corononavirus-HKU1
MLWLQ

SEQ ID NO: 3903 - protein, 24 aa, Corononavirus-HKU1
QVFLLKLYWLLLSVYIWDFKVVKY

SEQ ID NO: 3904 - protein, 38 aa, Corononavirus-HKU1; identical to SEQ ID NO: 907

SEQ ID NO: 3905 - protein, 8 aa, Corononavirus-HKU1
YLHFCLVV

SEQ ID NO: 3906 - protein, 16 aa, Corononavirus-HKU1
FLHLLNGLYLCILIHI

SEQ ID NO: 3907 - protein, 13 aa, Corononavirus-HKU1
LVLHYVYFVLLVL

SEQ ID NO: 3908 - protein, 7 aa, Corononavirus-HKU1
LNISIFI

SEQ ID NO: 3909 - protein, 9 aa, Corononavirus-HKU1
FLYSVPCFM

SEQ ID NO: 3910 - protein, 21 aa, Corononavirus-HKU1
LSIRKVLEVLLMSGSHILFLL

SEQ ID NO: 3911 - protein, 20 aa, Corononavirus-HKU1
ILLMFMKYFMVVFYVFLLFL

SEQ ID NO: 3912 - protein, 11 aa, Corononavirus-HKU1
LCIVLIMTFFL

SEQ ID NO: 3913 - protein, 6 aa, Corononavirus-HKU1
CFWLVE

SEQ ID NO: 3914 - protein, 9 aa, Corononavirus-HKU1
FLCGILGRI

SEQ ID NO: 3915 - protein, 11 aa, Corononavirus-HKU1
KRMFCYLLQPF

SEQ ID NO: 3916 - protein, 10 aa, Corononavirus-HKU1
VLIHGPLFCH

SEQ ID NO: 3917 - protein, 22 aa, Corononavirus-HKU1
QKLLLIGCLLIYFILQMYLILN

SEQ ID NO: 3918 - protein, 4 aa, Corononavirus-HKU1
VTYL

SEQ ID NO: 3919 - protein, 13 aa, Corononavirus-HKU1
GIFYLVIGDFSLF

SEQ ID NO: 3920 - protein, 22 aa, Corononavirus-HKU1
TVFLECLWVFIIIKFLFKNCVI

SEQ ID NO: 3921 - protein, 16 aa, Corononavirus-HKU1
MLMAYVHPVIVLRLFC

SEQ ID NO: 3922 - protein, 4 aa, Corononavirus-HKU1
NCLE

SEQ ID NO: 3923 - protein, 14 aa, Corononavirus-HKU1
VACQLLKFLKFNQN

SEQ ID NO: 3924 - protein, 7 aa, Corononavirus-HKU1
NVLMLFC

SEQ ID NO: 3925 - protein, 30 aa, Corononavirus-HKU1
IVYSICMLLLILGCGSIVVFYIMKYYLLQI

SEQ ID NO: 3926 - protein, 8 aa, Corononavirus-HKU1
LLISLLNY

SEQ ID NO: 3927 - protein, 17 aa, Corononavirus-HKU1
LFYSPILLQLILSVLQV

SEQ ID NO: 3928 - protein, 21 aa, Corononavirus-HKU1
MKLAMIMFKIVLFCRLCKVSL

SEQ ID NO: 3929 - protein, 28 aa, Corononavirus-HKU1
IWLVLLNMKSQRKIWLMLKIVVLLINNR

SEQ ID NO: 3930 - protein, 5 aa, Corononavirus-HKU1
KRHVI

SEQ ID NO: 3931 - protein, 10 aa, Corononavirus-HKU1
LSLCMNAIKL

SEQ ID NO: 3932 - protein, 9 aa, Corononavirus-HKU1
LANWNVWQT

SEQ ID NO: 3933 - protein, 37 aa, Corononavirus-HKU1; identical to SEQ ID NO: 936

SEQ ID NO: 3934 - protein, 13 aa, Corononavirus-HKU1
ILFWIMLLKVVYL

SEQ ID NO: 3935 - protein, 10 aa, Corononavirus-HKU1
MLFQRWLLIL

SEQ ID NO: 3936 - protein, 37 aa, Corononavirus-HKU1; identical to SEQ ID NO: 939

SEQ ID NO: 3937 - protein, 30 aa, Corononavirus-HKU1
LILVLILIGLLLLLLTGIMKLLMLLCRIMS

SEQ ID NO: 3938 - protein, 4 aa, Corononavirus-HKU1
CLIN

SEQ ID NO: 3939 - protein, 10 aa, Corononavirus-HKU1
KYKLLIVVLI

SEQ ID NO: 3940 - protein, 17 aa, Corononavirus-HKU1
IVTFLLNVIIIMVVVVE

SEQ ID NO: 3941 - protein, 15 aa, Corononavirus-HKU1
FMLFLVMLMVLSILR

SEQ ID NO: 3942 - protein, 8 aa, Corononavirus-HKU1
KMMEIVLF

SEQ ID NO: 3943 - protein, 29 aa, Corononavirus-HKU1
SLILLVNFLYKMLRDLKLSIFILLKDVTL

SEQ ID NO: 3944 - protein, 36 aa, Corononavirus-HKU1; identical to SEQ ID NO: 947

SEQ ID NO: 3945 - protein, 6 aa, Corononavirus-HKU1
ILRKLI

SEQ ID NO: 3946 - protein, 9 aa, Corononavirus-HKU1
IIYNKVVYL

SEQ ID NO: 3947 - protein, 42 aa, Corononavirus-HKU1
LIVLKCSVIMLVLVWLLLLNLRLLLIKILMVVPQFVFTAVHV

SEQ ID NO: 3948 - protein, 4 aa, Corononavirus-HKU1
SIQM

SEQ ID NO: 3949 - protein, 16 aa, Corononavirus-HKU1
MVCVNYVVNLYKSLWV

SEQ ID NO: 3950 - protein, 7 aa, Corononavirus-HKU1
KILFSMC

SEQ ID NO: 3951 - protein, 18 aa, Corononavirus-HKU1
HMMFVKFVDFGEMAVVPV

SEQ ID NO: 3952 - protein, 10 aa, Corononavirus-HKU1
VQVSLFNLKI

SEQ ID NO: 3953 - protein, 5 aa, Corononavirus-HKU1
TGSGY

SEQ ID NO: 3954 - protein, 9 aa, Corononavirus-HKU1
CECPSSTLC

SEQ ID NO: 3955 - protein, 4 aa, Corononavirus-HKU1
WFIY

SEQ ID NO: 3956 - protein, 6 aa, Corononavirus-HKU1
CSIKGI

SEQ ID NO: 3957 - protein, 7 aa, Corononavirus-HKU1
SWYRFIL

SEQ ID NO: 3958 - protein, 10 aa, Corononavirus-HKU1
SELLPFSAYR

SEQ ID NO: 3959 - protein, 4 aa, Corononavirus-HKU1
VLCC

SEQ ID NO: 3960 - protein, 4 aa, Corononavirus-HKU1
SRSL

SEQ ID NO: 3961 - protein, 5 aa, Corononavirus-HKU1
RENLL

SEQ ID NO: 3962 - protein, 6 aa, Corononavirus-HKU1
KLWCCG

SEQ ID NO: 3963 - protein, 4 aa, Corononavirus-HKU1
FLYI

SEQ ID NO: 3964 - protein, 7 aa, Corononavirus-HKU1
SCATYSS

SEQ ID NO: 3965 - protein, 17 aa, Corononavirus-HKU1
EPLKVYYVRSLLCIAPF

SEQ ID NO: 3966 - protein, 5 aa, Corononavirus-HKU1
LFSIV

SEQ ID NO: 3967 - protein, 5 aa, Corononavirus-HKU1
RILLF

SEQ ID NO: 3968 - protein, 4 aa, Corononavirus-HKU1
ERLV

SEQ ID NO: 3969 - protein, 6 aa, Corononavirus-HKU1
KIRPYF

SEQ ID NO: 3970 - protein, 20 aa, Corononavirus-HKU1
YCQFCRYFSKSRFSWCFNFR

SEQ ID NO: 3971 - protein, 8 aa, Corononavirus-HKU1
SRLVWSMV

SEQ ID NO: 3972 - protein, 32 aa, Corononavirus-HKU1
FYTNSSRFWCGSCRFLLFLYDAYVDYVSCIRL

SEQ ID NO: 3973 - protein, 7 aa, Corononavirus-HKU1
TIRSCTV

SEQ ID NO: 3974 - protein, 4 aa, Corononavirus-HKU1
VRIV

SEQ ID NO: 3975 - protein, 8 aa, Corononavirus-HKU1
VLGYEVSS

SEQ ID NO: 3976 - protein, 4 aa, Corononavirus-HKU1
YCGL

SEQ ID NO: 3977 - protein, 6 aa, Corononavirus-HKU1
VYYSLC

SEQ ID NO: 3978 - protein, 4 aa, Corononavirus-HKU1
YGLT

SEQ ID NO: 3979 - protein, 7 aa, Corononavirus-HKU1
YLFWSSC

SEQ ID NO: 3980 - protein, 17 aa, Corononavirus-HKU1
TNFCRWCSVCCFNWLPL

SEQ ID NO: 3981 - protein, 10 aa, Corononavirus-HKU1
RVRCSYELGC

SEQ ID NO: 3982 - protein, 8 aa, Corononavirus-HKU1
YTPLSFVS

SEQ ID NO: 3983 - protein, 16 aa, Corononavirus-HKU1
RLTSLCSRSCYACCIC

SEQ ID NO: 3984 - protein, 6 aa, Corononavirus-HKU1
FTNLLF

SEQ ID NO: 3985 - protein, 13 aa, Corononavirus-HKU1
CSCHYKWYKVSNC

SEQ ID NO: 3986 - protein, 4 aa, Corononavirus-HKU1
PRFL

SEQ ID NO: 3987 - protein, 4 aa, Corononavirus-HKU1
VCQK

SEQ ID NO: 3988 - protein, 10 aa, Corononavirus-HKU1
FETLFLYSRW

SEQ ID NO: 3989 - protein, 4 aa, Corononavirus-HKU1
CCNY

SEQ ID NO: 3990 - protein, 5 aa, Corononavirus-HKU1
FTYYG

SEQ ID NO: 3991 - protein, 10 aa, Corononavirus-HKU1
AVIVCIRSCL

SEQ ID NO: 3992 - protein, 11 aa, Corononavirus-HKU1
WWLYTSITSYC

SEQ ID NO: 3993 - protein, 7 aa, Corononavirus-HKU1
QKCWLSI

SEQ ID NO: 3994 - protein, 4 aa, Corononavirus-HKU1
GIII

SEQ ID NO: 3995 - protein, 5 aa, Corononavirus-HKU1
NLCIY

SEQ ID NO: 3996 - protein, 14 aa, Corononavirus-HKU1
CVAHFNSNEFKICY

SEQ ID NO: 3997 - protein, 10 aa, Corononavirus-HKU1
SSYCCRCFHS

SEQ ID NO: 3998 - protein, 28 aa, Corononavirus-HKU1
YYDRSNVSSKMFEEYSSYSWCSCCYRNY

SEQ ID NO: 3999 - protein, 6 aa, Corononavirus-HKU1
ILWWLG

SEQ ID NO: 4000 - protein, 9 aa, Corononavirus-HKU1
YVTPSYKGC

SEQ ID NO: 4001 - protein, 10 aa, Corononavirus-HKU1
QPCSYGLGLS

SEQ ID NO: 4002 - protein, 10 aa, Corononavirus-HKU1
SCHAKYFAYC

SEQ ID NO: 4003 - protein, 5 aa, Corononavirus-HKU1
FSFGS

SEQ ID NO: 4004 - protein, 6 aa, Corononavirus-HKU1
ILLFTW

SEQ ID NO: 4005 - protein, 6 aa, Corononavirus-HKU1
ILSPCE

SEQ ID NO: 4006 - protein, 6 aa, Corononavirus-HKU1
MCSSFE

SEQ ID NO: 4007 - protein, 10 aa, Corononavirus-HKU1
NSYVWRLLLC

SEQ ID NO: 4008 - protein, 4 aa, Corononavirus-HKU1
AWWY

SEQ ID NO: 4009 - protein, 6 aa, Corononavirus-HKU1
CNHCFC

SEQ ID NO: 4010 - protein, 7 aa, Corononavirus-HKU1
YMSSCYC

SEQ ID NO: 4011 - protein, 7 aa, Corononavirus-HKU1
CLFSYGL

SEQ ID NO: 4012 - protein, 13 aa, Corononavirus-HKU1
RFKYTQFTKTLIL

SEQ ID NO: 4013 - protein, 7 aa, Corononavirus-HKU1
CLSYRLC

SEQ ID NO: 4014 - protein, 4 aa, Corononavirus-HKU1
LYIC

SEQ ID NO: 4015 - protein, 5 aa, Corononavirus-HKU1
YDDFE

SEQ ID NO: 4016 - protein, 5 aa, Corononavirus-HKU1
WCCLL

SEQ ID NO: 4017 - protein, 17 aa, Corononavirus-HKU1
GLYSQYKCFSTSFVLSE

SEQ ID NO: 4018 - protein, 4 aa, Corononavirus-HKU1
RFYV

SEQ ID NO: 4019 - protein, 9 aa, Corononavirus-HKU1
ILFTTYYVG

SEQ ID NO: 4020 - protein, 10 aa, Corononavirus-HKU1
LCLSTLSRPF

SEQ ID NO: 4021 - protein, 8 aa, Corononavirus-HKU1
NFRSWLFC

SEQ ID NO: 4022 - protein, 4 aa, Corononavirus-HKU1
FIED

SEQ ID NO: 4023 - protein, 21 aa, Corononavirus-HKU1
QCSFDRALCKSSYRCLPFSTP

SEQ ID NO: 4024 - protein, 17 aa, Corononavirus-HKU1
RIPKSFSCIFRIYKKTI

SEQ ID NO: 4025 - protein, 4 aa, Corononavirus-HKU1
SDLR

SEQ ID NO: 4026 - protein, 6 aa, Corononavirus-HKU1
CYFKYL

SEQ ID NO: 4027 - protein, 5 aa, Corononavirus-HKU1
WFKVH

SEQ ID NO: 4028 - protein, 37 aa, Corononavirus-HKU1
EYVFKKCRDAECRCMCCLFITDVFALWQLYTEAFVVL

SEQ ID NO: 4029 - protein, 7 aa, Corononavirus-HKU1
SCYGNQS

SEQ ID NO: 4030 - protein, 10 aa, Corononavirus-HKU1
ICFECFTLCV

SEQ ID NO: 4031 - protein, 13 aa, Corononavirus-HKU1
CHQIIFGWYVLLL

SEQ ID NO: 4032 - protein, 5 aa, Corononavirus-HKU1
TSLFI

SEQ ID NO: 4033 - protein, 11 aa, Corononavirus-HKU1
VSYEWYGLWFV

SEQ ID NO: 4034 - protein, 10 aa, Corononavirus-HKU1
TILYRFTLYR

SEQ ID NO: 4035 - protein, 4 aa, Corononavirus-HKU1
MDRS

SEQ ID NO: 4036 - protein, 5 aa, Corononavirus-HKU1
LCSGK

SEQ ID NO: 4037 - protein, 13 aa, Corononavirus-HKU1
TFKVICCRNSKGN

SEQ ID NO: 4038 - protein, 12 aa, Corononavirus-HKU1
TKLCFCYYSRDC

SEQ ID NO: 4039 - protein, 9 aa, Corononavirus-HKU1
RNYFVLGDR

SEQ ID NO: 4040 - protein, 10 aa, Corononavirus-HKU1
KLCFHWLSFY

SEQ ID NO: 4041 - protein, 4 aa, Corononavirus-HKU1
DSFR

SEQ ID NO: 4042 - protein, 15 aa, Corononavirus-HKU1
WCLLSRYNYLQTFYR

SEQ ID NO: 4043 - protein, 10 aa, Corononavirus-HKU1
CFCLNITFCS

SEQ ID NO: 4044 - protein, 13 aa, Corononavirus-HKU1
SKCTYTCSTRELC

SEQ ID NO: 4045 - protein, 4 aa, Corononavirus-HKU1
YKIF

SEQ ID NO: 4046 - protein, 7 aa, Corononavirus-HKU1
RSFAVSN

SEQ ID NO: 4047 - protein, 41 aa, Corononavirus-HKU1
LSAHWNETLLHCARSSWYGQVSPCYRFSCLLLYSTCSLYCC

SEQ ID NO: 4048 - protein, 8 aa, Corononavirus-HKU1
SCCCRCIV

SEQ ID NO: 4049 - protein, 4 aa, Corononavirus-HKU1
VFKY

SEQ ID NO: 4050 - protein, 7 aa, Corononavirus-HKU1
LYTHYTC

SEQ ID NO: 4051 - protein, 6 aa, Corononavirus-HKU1
SSCRLL

SEQ ID NO: 4052 - protein, 19 aa, Corononavirus-HKU1
VCFYYNKCITRVSHRYCCC

SEQ ID NO: 4053 - protein, 8 aa, Corononavirus-HKU1
IVCYKCSC

SEQ ID NO: 4054 - protein, 19 aa, Corononavirus-HKU1
TLCIYWRSCSVTCTTCAIE

SEQ ID NO: 4055 - protein, 5 aa, Corononavirus-HKU1
GFFRT

SEQ ID NO: 4056 - protein, 7 aa, Corononavirus-HKU1
NNVLFRS

SEQ ID NO: 4057 - protein, 7 aa, Corononavirus-HKU1
YFFGKLL

SEQ ID NO: 4058 - protein, 11 aa, Corononavirus-HKU1
RNCRNCFSIGL

SEQ ID NO: 4059 - protein, 4 aa, Corononavirus-HKU1
FIML

SEQ ID NO: 4060 - protein, 5 aa, Corononavirus-HKU1
GTDNT

SEQ ID NO: 4061 - protein, 13 aa, Corononavirus-HKU1
EFKCCKYSTNIFN

SEQ ID NO: 4062 - protein, 4 aa, Corononavirus-HKU1
IFES

SEQ ID NO: 4063 - protein, 4 aa, Corononavirus-HKU1
SSLE

SEQ ID NO: 4064 - protein, 4 aa, Corononavirus-HKU1
CCFY

SEQ ID NO: 4065 - protein, 5 aa, Corononavirus-HKU1
SELCC

SEQ ID NO: 4066 - protein, 10 aa, Corononavirus-HKU1
AYFRCSNTNC

SEQ ID NO: 4067 - protein, 5 aa, Corononavirus-HKU1
FCSRF

SEQ ID NO: 4068 - protein, 14 aa, Corononavirus-HKU1
LCYIFTNSRNSSFY

SEQ ID NO: 4069 - protein, 4 aa, Corononavirus-HKU1
CCHN

SEQ ID NO: 4070 - protein, 10 aa, Corononavirus-HKU1
SQEGYFLCYE

SEQ ID NO: 4071 - protein, 4 aa, Corononavirus-HKU1
YAII

SEQ ID NO: 4072 - protein, 7 aa, Corononavirus-HKU1
FYYFTFR

SEQ ID NO: 4073 - protein, 13 aa, Corononavirus-HKU1
NSESNFISFALYY

SEQ ID NO: 4074 - protein, 16 aa, Corononavirus-HKU1
KFFRLPPSSCSFIFIS

SEQ ID NO: 4075 - protein, 12 aa, Corononavirus-HKU1
GQRRFGCLFKHL

SEQ ID NO: 4076 - protein, 14 aa, Corononavirus-HKU1
TCFNIFSFNISHGV

SEQ ID NO: 4077 - protein, 5 aa, Corononavirus-HKU1
IGFDS

SEQ ID NO: 4078 - protein, 4 aa, Corononavirus-HKU1
IFYY

SEQ ID NO: 4079 - protein, 4 aa, Corononavirus-HKU1
RRSY

SEQ ID NO: 4080 - protein, 5 aa, Corononavirus-HKU1
RLGWF

SEQ ID NO: 4081 - protein, 8 aa, Corononavirus-HKU1
CRRSPCYA

SEQ ID NO: 4082 - protein, 16 aa, Corononavirus-HKU1
QHWNKLSIANRFFNWC

SEQ ID NO: 4083 - protein, 6 aa, Corononavirus-HKU1
SYWLIC

SEQ ID NO: 4084 - protein, 6 aa, Corononavirus-HKU1
ERLLYI

SEQ ID NO: 4085 - protein, 4 aa, Corononavirus-HKU1
KNCC

SEQ ID NO: 4086 - protein, 4 aa, Corononavirus-HKU1
SSSW

SEQ ID NO: 4087 - protein, 15 aa, Corononavirus-HKU1
TFNTPYVERSKVGCC

SEQ ID NO: 4088 - protein, 8 aa, Corononavirus-HKU1
NQNCSNVV

SEQ ID NO: 4089 - protein, 6 aa, Corononavirus-HKU1
LSFGSF

SEQ ID NO: 4090 - protein, 10 aa, Corononavirus-HKU1
CSIYYLVCQF

SEQ ID NO: 4091 - protein, 8 aa, Corononavirus-HKU1
TYVFKVFC

SEQ ID NO: 4092 - protein, 4 aa, Corononavirus-HKU1
RAQL

SEQ ID NO: 4093 - protein, 5 aa, Corononavirus-HKU1
SCNML

SEQ ID NO: 4094 - protein, 9 aa, Corononavirus-HKU1
NWLLRLLAP

SEQ ID NO: 4095 - protein, 16 aa, Corononavirus-HKU1
PAYCRYTTVGLHRFFN

SEQ ID NO: 4096 - protein, 7 aa, Corononavirus-HKU1
RCTCCII

SEQ ID NO: 4097 - protein, 10 aa, Corononavirus-HKU1
CNYDSVFSNL

SEQ ID NO: 4098 - protein, 10 aa, Corononavirus-HKU1
LEFRVSNNFQ

SEQ ID NO: 4099 - protein, 5 aa, Corononavirus-HKU1
YKYIL

SEQ ID NO: 4100 - protein, 7 aa, Corononavirus-HKU1
VIAACYA

SEQ ID NO: 4101 - protein, 5 aa, Corononavirus-HKU1
SCHAM

SEQ ID NO: 4102 - protein, 5 aa, Corononavirus-HKU1
IQFML

SEQ ID NO: 4103 - protein, 4 aa, Corononavirus-HKU1
HWQS

SEQ ID NO: 4104 - protein, 8 aa, Corononavirus-HKU1
RYCLCQRL

SEQ ID NO: 4105 - protein, 8 aa, Corononavirus-HKU1
CFSCCQVC

SEQ ID NO: 4106 - protein, 6 aa, Corononavirus-HKU1
TVVLCL

SEQ ID NO: 4107 - protein, 9 aa, Corononavirus-HKU1
GWFMYVLEL

SEQ ID NO: 4108 - protein, 4 aa, Corononavirus-HKU1
FNCL

SEQ ID NO: 4109 - protein, 5 aa, Corononavirus-HKU1
YSGIK

SEQ ID NO: 4110 - protein, 6 aa, Corononavirus-HKU1
IKPPWM

SEQ ID NO: 4111 - protein, 5 aa, Corononavirus-HKU1
TCISY

SEQ ID NO: 4112 - protein, 7 aa, Corononavirus-HKU1
SFYQNGL

SEQ ID NO: 4113 - protein, 23 aa, Corononavirus-HKU1
TYAIFLLFRYSLCVCRWFGIQTS

SEQ ID NO: 4114 - protein, 13 aa, Corononavirus-HKU1
LCAFKKRYLYHTM

SEQ ID NO: 4115 - protein, 7 aa, Corononavirus-HKU1
FRWCCLF

SEQ ID NO: 4116 - protein, 12 aa, Corononavirus-HKU1
CSYYSRLYFLGL

SEQ ID NO: 4117 - protein, 16 aa, Corononavirus-HKU1
FMEYFHYVAELRKCNI

SEQ ID NO: 4118 - protein, 4 aa, Corononavirus-HKU1
CWSL

SEQ ID NO: 4119 - protein, 4 aa, Corononavirus-HKU1
WTYR

SEQ ID NO: 4120 - protein, 7 aa, Corononavirus-HKU1
IALCYYE

SEQ ID NO: 4121 - protein, 4 aa, Corononavirus-HKU1
QSCC

SEQ ID NO: 4122 - protein, 6 aa, Corononavirus-HKU1
CRYCYF

SEQ ID NO: 4123 - protein, 5 aa, Corononavirus-HKU1
YITSY

SEQ ID NO: 4124 - protein, 5 aa, Corononavirus-HKU1
IIYKT

SEQ ID NO: 4125 - protein, 5 aa, Corononavirus-HKU1
YSPSP

SEQ ID NO: 4126 - protein, 4 aa, Corononavirus-HKU1
KFEY

SEQ ID NO: 4127 - protein, 11 aa, Corononavirus-HKU1
YLLEACPLGLC

SEQ ID NO: 4128 - protein, 14 aa, Corononavirus-HKU1
FYLWCLQIHRFKFY

SEQ ID NO: 4129 - protein, 6 aa, Corononavirus-HKU1
KFECTF

SEQ ID NO: 4130 - protein, 7 aa, Corononavirus-HKU1
QWCFRSF

SEQ ID NO: 4131 - protein, 8 aa, Corononavirus-HKU1
KSKKWCFY

SEQ ID NO: 4132 - protein, 5 aa, Corononavirus-HKU1
YWKIK

SEQ ID NO: 4133 - protein, 4 aa, Corononavirus-HKU1
FVYD

SEQ ID NO: 4134 - protein, 5 aa, Corononavirus-HKU1
RSATS

SEQ ID NO: 4135 - protein, 7 aa, Corononavirus-HKU1
FKWRNCG

SEQ ID NO: 4136 - protein, 6 aa, Corononavirus-HKU1
SWRTQC

SEQ ID NO: 4137 - protein, 9 aa, Corononavirus-HKU1
VLVCYEKRW

SEQ ID NO: 4138 - protein, 20 aa, Corononavirus-HKU1
RCYLQPCRQPKPKPLLEPTR

SEQ ID NO: 4139 - protein, 17 aa, Corononavirus-HKU1
CSSAFYYLYSESCIVNL

SEQ ID NO: 4140 - protein, 10 aa, Corononavirus-HKU1
TSLRFRTGFY

SEQ ID NO: 4141 - protein, 13 aa, Corononavirus-HKU1
SVYSQIWFRRLCI

SEQ ID NO: 4142 - protein, 5 aa, Corononavirus-HKU1
SYSLW

SEQ ID NO: 4143 - protein, 13 aa, Corononavirus-HKU1
SYRRFALAYRFIS

SEQ ID NO: 4144 - protein, 4 aa, Corononavirus-HKU1
TKKI

SEQ ID NO: 4145 - protein, 9 aa, Corononavirus-HKU1
FGNSRVFAV

SEQ ID NO: 4146 - protein, 7 aa, Corononavirus-HKU1
YSFIFHY

SEQ ID NO: 4147 - protein, 4 aa, Corononavirus-HKU1
SRVW

SEQ ID NO: 4148 - protein, 6 aa, Corononavirus-HKU1
ECLYSY

SEQ ID NO: 4149 - protein, 4 aa, Corononavirus-HKU1
FIIR

SEQ ID NO: 4150 - protein, 5 aa, Corononavirus-HKU1
LCCYC

SEQ ID NO: 4151 - protein, 7 aa, Corononavirus-HKU1
VIKFELC

SEQ ID NO: 4152 - protein, 8 aa, Corononavirus-HKU1
GLSIYVVV

SEQ ID NO: 4153 - protein, 6 aa, Corononavirus-HKU1
NYDFLS

SEQ ID NO: 4154 - protein, 4 aa, Corononavirus-HKU1
NASY

SEQ ID NO: 4155 - protein, 11 aa, Corononavirus-HKU1
LETWLFYACFI

SEQ ID NO: 4156 - protein, 15 aa, Corononavirus-HKU1
VFECSIRESFFMELW

SEQ ID NO: 4157 - protein, 10 aa, Corononavirus-HKU1
FTNRLYDECC

SEQ ID NO: 4158 - protein, 17 aa, Corononavirus-HKU1
VYSIMSVFKYYNISCSC

SEQ ID NO: 4159 - protein, 10 aa, Corononavirus-HKU1
YACLTLRCRI

SEQ ID NO: 4160 - protein, 16 aa, Corononavirus-HKU1
RSSPWFCCFKTVVTIW

SEQ ID NO: 4161 - protein, 4 aa, Corononavirus-HKU1
YSCR

SEQ ID NO: 4162 - protein, 5 aa, Corononavirus-HKU1
FKSFC

SEQ ID NO: 4163 - protein, 13 aa, Corononavirus-HKU1
FSHLFWRLYDFTI

SEQ ID NO: 4164 - protein, 8 aa, Corononavirus-HKU1
LSLGSDNI

SEQ ID NO: 4165 - protein, 12 aa, Corononavirus-HKU1
GWFLYLYLLFNS

SEQ ID NO: 4166 - protein, 5 aa, Corononavirus-HKU1
IIFGW

SEQ ID NO: 4167 - protein, 12 aa, Corononavirus-HKU1
CCYKNYRIFLEC

SEQ ID NO: 4168 - protein, 13 aa, Corononavirus-HKU1
INELFCILDSFLY

SEQ ID NO: 4169 - protein, 5 aa, Corononavirus-HKU1
CKCFF

SEQ ID NO: 4170 - protein, 10 aa, Corononavirus-HKU1
RVFNRYKLFG

SEQ ID NO: 4171 - protein, 15 aa, Corononavirus-HKU1
NRWQCYACQLFVLEK

SEQ ID NO: 4172 - protein, 8 aa, Corononavirus-HKU1
YNMEWWCL

SEQ ID NO: 4173 - protein, 19 aa, Corononavirus-HKU1
IFFEIGWHCCSKFKTRSIK

SEQ ID NO: 4174 - protein, 6 aa, Corononavirus-HKU1
FSLFSY

SEQ ID NO: 4175 - protein, 4 aa, Corononavirus-HKU1
VISA

SEQ ID NO: 4176 - protein, 5 aa, Corononavirus-HKU1
RNFCW

SEQ ID NO: 4177 - protein, 11 aa, Corononavirus-HKU1
SCKHLLDLSVC

SEQ ID NO: 4178 - protein, 386 aa, Corononavirus-HKU1
TMLIIFLFFNFCYGFNEPLNVVSHLNHDWFLFGDSRSDCNHINNLKIKNYGYLDIHPSLCNNGKISSSAGDSIFKSYHFTRFYNYTGEGDQIIFYEGVNFNPHHRFKCFFNGSNDVWIFNKVRFYRALYSNMALFRYLTFVDILYNFSFSIKANICNSNILSLNNPIFISTNYSKDVYFTLSGCSLYLVPLCLFKSNFSQYYYNMDTGFAYGYSNFVSSDLDCTYISLKPGSYKIFSTGFVLSIPTKALCFNKSKQFVPVQVVDSRWNNLRASDTSLSDACQLPYCYFRNSSGNYVGKYDINHGDNGFTSILSGLLYNVSCISYYGSFLYDNFTSIWPRFSFGNCPTSAYIKLNCFYDPLPIILQGILLFLALLFIVFLLFLVYHG

SEQ ID NO: 4179 - protein, 8 aa, Corononavirus-HKU1
LFLFCLQH

SEQ ID NO: 4180 - protein, 19 aa, Corononavirus-HKU1
VILIVLTLLLMIIIKPFRV

SEQ ID NO: 4181 - protein, 21 aa, Corononavirus-HKU1
ARMLLMYLLVWAHIMFLTVFI

SEQ ID NO: 4182 - protein, 21 aa, Corononavirus-HKU1
ILPCYLQVIFLNLVLILETWL

SEQ ID NO: 4183 - protein, 5 aa, Corononavirus-HKU1
RVLNI

SEQ ID NO: 4184 - protein, 38 aa, Corononavirus-HKU1
VLSGINHLFCQILIMVFFLRLRILSYMLIILCIVNLVL

SEQ ID NO: 4185 - protein, 89 aa, Corononavirus-HKU1
VVFLLILLILLLFNLTMVFWRLQLVSILCVNILTLFVSLRVVFVMNLGTLILRNLYACLRKILLIMFLQIGCIFIFIKNVVFFMHIMQM

SEQ ID NO: 4186 - protein, 11 aa, Corononavirus-HKU1
VCLPLSYLVYI

SEQ ID NO: 4187 - protein, 11 aa, Corononavirus-HKU1
VLFYLIIMLCL

SEQ ID NO: 4188 - protein, 13 aa, Corononavirus-HKU1
LVRLYLQILTMKL

SEQ ID NO: 4189 - protein, 56 aa, Corononavirus-HKU1
NIGLHRYLDVSIFLILMSTVLLLMPLIVQVVFLVRFNVKLNLLHLILVFMICLVLL

SEQ ID NO: 4190 - protein, 44 aa, Corononavirus-HKU1
SLLQLFIVGFLIYLIVTLTTGLIMLVYLHLLIGNVEFFLIVTSI

SEQ ID NO: 4191 - protein, 5 aa, Corononavirus-HKU1
ALYFV

SEQ ID NO: 4192 - protein, 53 aa, Corononavirus-HKU1
FMLILFLVIILINLKFLVVALIVLLLTSLLYLIADEMICNWAVLAFCNHLITK

SEQ ID NO: 4193 - protein, 14 aa, Corononavirus-HKU1
IFLLVLVNCIIVYL

SEQ ID NO: 4194 - protein, 110 aa, Corononavirus-HKU1
LMLLLITLIHLLGIGGMVLVVLMCLLMTLFILIIVFLLTATFALVQIRLLLILVLNLSLFLPFVLLVLNIVIATWILLFMLITGVDVLVYLTPFLLILLTHVLKRRSLLV

SEQ ID NO: 4195 - protein, 17 aa, Corononavirus-HKU1
VNIVQVLVLMRKNVVHN

SEQ ID NO: 4196 - protein, 101 aa, Corononavirus-HKU1
IIVPVLVVLMPFWVGLLIVVLVIIVAIFFLILFLMELIVAPLVLMICYILTLKFLLVFVLIMIFMASQAKVFLKKFLRLIIIIGRIFCMILMVILLVLKIF

SEQ ID NO: 4197 - protein, 32 aa, Corononavirus-HKU1
LIKLTLYFLVILVECLLHFIKILLHQLCFIVI

SEQ ID NO: 4198 - protein, 5 aa, Corononavirus-HKU1
SVVMF

SEQ ID NO: 4199 - protein, 19 aa, Corononavirus-HKU1
IIFLLSHNHFILIVILVVF

SEQ ID NO: 4200 - protein, 4 aa, Corononavirus-HKU1
MLLI

SEQ ID NO: 4201 - protein, 38 aa, Corononavirus-HKU1
LAILYPLVICVWVVGFVLIMLYPLLGVSVEVFLLLIAL

SEQ ID NO: 4202 - protein, 30 aa, Corononavirus-HKU1
LLNPLMLVLLTIVLKLLVVYLRFRFLLTLP

SEQ ID NO: 4203 - protein, 46 aa, Corononavirus-HKU1
LVMKNLFRLVLLKLLLIVQLLFALIMLLVMIYCRNMALFAIILIVF

SEQ ID NO: 4204 - protein, 17 aa, Corononavirus-HKU1
MKSMIYLILLSCRLLML

SEQ ID NO: 4205 - protein, 20 aa, Corononavirus-HKU1
CKVLHLVLILILIYTLMLII

SEQ ID NO: 4206 - protein, 5 aa, Corononavirus-HKU1
ILNLF

SEQ ID NO: 4207 - protein, 11 aa, Corononavirus-HKU1
VHNVVLRLDLC

SEQ ID NO: 4208 - protein, 12 aa, Corononavirus-HKU1
RIYYSTRSNFQM

SEQ ID NO: 4209 - protein, 86 aa, Corononavirus-HKU1
VLLKLIIIALVVVKLEIFSVCNLLMVLKYYLPFYLRLKFLAILQLLLWRLCFRHGLLLLVYHFLLMYNIELMVWVLLWMFLIRIKS

SEQ ID NO: 4210 - protein, 63 aa, Corononavirus-HKU1
LMLLIKLFFLSRMVLLLLTLLLLKFKVSLMLMLKHLIVCYNNYLINLVLLVLLYKKFCLALII

SEQ ID NO: 4211 - protein, 13 aa, Corononavirus-HKU1
KLRFRLIGSLMVV

SEQ ID NO: 4212 - protein, 35 aa, Corononavirus-HKU1
MLMFLNSLVILHLLRLELLVLLRRLMSVLKVNPLV

SEQ ID NO: 4213 - protein, 35 aa, Corononavirus-HKU1
IFVAMVTTFYHWFKMLLMVCFSFILVINLLLLKLS

SEQ ID NO: 4214 - protein, 46 aa, Corononavirus-HKU1
VQVYVYPVIEVLHLSKVILLNKMIPGCLLVVPIITQNQFQIKMLFS

SEQ ID NO: 4215 - protein, 38 aa, Corononavirus-HKU1
IVALLILLKLHLFILIILYQICLILKPSFLFGLKIILL

SEQ ID NO: 4216 - protein, 10 aa, Corononavirus-HKU1
PLILILMLLF

SEQ ID NO: 4217 - protein, 5 aa, Corononavirus-HKU1
ICIMK

SEQ ID NO: 4218 - protein, 9 aa, Corononavirus-HKU1
MLFRNLLNL

SEQ ID NO: 4219 - protein, 9 aa, Corononavirus-HKU1
TVVLLILKK

SEQ ID NO: 4220 - protein, 15 aa, Corononavirus-HKU1
VLMKCMLNGLGTFGC

SEQ ID NO: 4221 - protein, 5 aa, Corononavirus-HKU1
LSFYL

SEQ ID NO: 4222 - protein, 42 aa, Corononavirus-HKU1
YFSLYAAVLVVVQHVLVNVIIVVMSMGVTMILLLKHLMMIRF

SEQ ID NO: 4223 - protein, 112 aa, Corononavirus-HKU1
TLYMEVWRPSYKYSLITREFGVTDLEDLCFKYNYCQPCVGYCIVPLNVWCRKFGKFASYFVLRSHDTSHKNNFGVITSFTSYGNTVSEAVSKLVESASDFIAWRAEALNKYG

SEQ ID NO: 4224 - protein, 4 aa, Corononavirus-HKU1
CIFH

SEQ ID NO: 4225 - protein, 29 aa, Corononavirus-HKU1
YCLVCRSDFLFSFILCHFLNFCCCTFSNY

SEQ ID NO: 4226 - protein, 9 aa, Corononavirus-HKU1
TLYSNLWFL

SEQ ID NO: 4227 - protein, 11 aa, Corononavirus-HKU1
YFYYFTFCLCL

SEQ ID NO: 4228 - protein, 8 aa, Corononavirus-HKU1
TCHTFYFR

SEQ ID NO: 4229 - protein, 230 aa, Corononavirus-HKU1
FNLNLNIMNESIFPHWNSDQAITFLKEWNFSLGVILLLITIILQFGYTSRSMFVYLIKMIILWLMWPLTIILTIFNCFYALNNIFLGLSILFTIISIVIWILYFVNSIRLFIRTGSWWSFNPETNNLMCIDMKGKMYVRPVIEDYHTLTATVIRGHLYIQGVKLGTGYTLADLPVYVTVAKVQVLCTYKRAFLDKLDVNSGFAVFVKSKVGNYRLPSSKSSGMDTALLRA

SEQ ID NO: 4230 - protein, 444 aa, Corononavirus-HKU1
  misc_feature (437)..(437): The 'Xaa' at location 437 stands for Thr, Ala, Pro, or Ser.
TIRMSYTPGHHAGSRSSSGNRSGILKKTSWVDQSERSHQTYNRGRKPQPKFTVSTQPQGNPIPHYSWFSGITQFQKGRDFKFPDGQGVPIAYGIPPSEAKGYWYKHNRRSFKTADGQQKQLLPRWYFYYLGTGPYASSSYGDAHEGIFWVASHQADTSIPSDVSARDPTIQEAIPTRFSPGTILPQGYYVEGSGRSASNSRPGSRSQSRGPNNRSLSRSNSNFRHSDSIVKPDMADEIASLVLAKLGKDSKPQQVTKQNAKEIRHKILMKPRQKRTPNKFCNVQQCFGKRGPLQNFGNSEMLKLGTNDPQFPILAELAPTPGAFFFGSKLELFKRDSDADSPSKDTFELRYSGSIRFDSTLPGFETIMKVLKENLDAYVNSNQNTVSGSLSPKPQRKRGVKQSPESFDSLNLSADTQHISNDFTPEDHSLLATLDDXYVEDSVA

SEQ ID NO: 4231 - protein, 5 aa, Corononavirus-HKU1
ILIRH

SEQ ID NO: 4232 - protein, 6 aa, Corononavirus-HKU1
VVTPRY

SEQ ID NO: 4233 - protein, 15 aa, Corononavirus-HKU1
DTLYQNEFLLLQQIE

SEQ ID NO: 4234 - protein, 35 aa, Corononavirus-HKU1
VVADYILISRNFIFKYLIVRVVIRFSCSINASGKS

SEQ ID NO: 4235 - protein, 9 aa, Corononavirus-HKU1
YLIYILVYD

SEQ ID NO: 4236 - protein, 10 aa, Corononavirus-HKU1
PFGGITKKKK

SEQ ID NO: 4237 - protein, 356 aa, Murine hepatitis virus
VGEIEPAVFEDDVVDVVKAPLTYQGCCKPPTSFEKICIVDKLYMAKCGDQFYPVVVDNDTVGVLDQCWRFPCAGKKVEFNDKPKVRKIPSTRKIKITFALDATFDSVLSKACSEFEVDKDVTLDELLDVVLDAVESTLSPCKEHDVIGTKVCALLDRLAGDYVYLFDEGGDEVIAPRMYCSFSAPDDEDCVAADVVDADENQDDDAEDSAVLVADTQEEDGVAKGQVEADSEICVAHTGSQEELAEPDAVGSQTPIASAEETEVGEASDREGIAEAKATVCADAVDACPDQVEAFEIEKVEDSILDELQTELNAPADKTYEDVLAFDAVCSEALSAFYAVPSDETHFKVCGFYSPA

SEQ ID NO: 4238 - protein, 289 aa, Bovine coronavirus
KGSGSDFSLADSVVEVVTTSLTPCGYSEPPKVADKICIVDNVYMAKAGDKYYPVVVDGHVGLLDQAWRVPCAGRRVTFKEQPTVNEIASTPKTIKVFYELDKDFNTILNTACGVFEVDDTVDMEEFYAVVIDAIEEKLSPCKELEGVGAKVSAFLQKLEDNSLFLFDEAGEEVLASKLYCAFTAPEDDDFLEESGVEEDDVEGEETDLTVTSAGEPCVASEQEESSEILEDTLDDGPCVETSDSQVEEDVEMSDFADLESVIQDYENVCFEFYTTEPEFVKVLDLYVPK

SEQ ID NO: 4239 - protein, 289 aa, Human coronavirus-OC43
KGSGSDFSLADSVVEVVTTSLTPCGYSEPPKVADKICIVDNVYMAKAGDKYYPVVVDDHVGLLDQAWRVPCAGRRVTFKEQPTVKEIISMPKIIKVFYELDNDFNTILNTACGVFEVDDTVDMEEFYAVVIDAIEEKLSPCKELEGVGAKVSAFLQKLEDNPLFLFDEAGEEVLAPKLYCAFTAPEDDDFLEESDVEEDDVEGEETDLTVTSAGQPCVASEQEESSEVLEDTLDDGPSVETSDSQVEEDVEMSDFVDLESVIQDYENVCFEFYTTEPEFVKVLGLYVPK

SEQ ID NO: 4240 - protein, 419 aa, Corononavirus-HKU1
EGVAESVIVEDDVIENVKSSLSSYEYCQPPKSVEKICIIDNMYMGKCGDKFFPIVMNDKNICLLDQAWRFPCAGRKVNFNEKPVVMEIPSLMTVKVMFDLDSTFDDILGKVCSEFEVEKGVTVDDFVAVVCDAIENALNSCKEHPVVGYQVRAFLNKLNENVVYLFDEAGDEAMASRMYCTFAIEDVEDVISSEAVEDTIDGVVEDTINDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNNDEEIVTGDNDDQIVVTGDDVDDIESIYDFDTYKALLVFNDVYNDALFVSYGSSVETETYFKVNGLWSPT

SEQ ID NO: 4241 - protein, 389 aa, Corononavirus-HKU1
EGVAESVIVEDDVIENVKSSLSSYEYCQPPKSVEKICIIDNMYMGKCGDKFFPIVMNDKNICLLDQAWRFPCAGRKVNFNEKPVVMEIPSLMTVKVMFDLDSTFDDILGKVCSEFEVEKGVTVDDFVAVVCDAIENALNSCKDHPVVGYQVRAFLNKLNENVVYLFDEAGDEAMASRMYCTFAIEDVEDVISSEAVEDTIDGVVEDTINDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEEIVTGDNDDQIVVTGDDVDDIESIYDFDTYKALLVFNDVYNDALFVSYGSSVETETYFKVNGLWSPT

SEQ ID NO: 4242 - DNA, 2784 bp, Corononavirus-HKU1
  CDS (1)..(2784)
tctaaagatttaaattttttaaaccgggttcggggtactagtgtgaatgcccggctagtaccctgtgctagtggtttatctactgatgttcaattaagggcatttgacatttgtaataccaatagagctggtataggtttatattataaagtgaattgttgccgttttcagcgtatagatgacgacggtaataaattggataagttctttgttgtcaaaagaactaatttagaagtttataataaagagaaaacttattatgagttgactaaaagttgtggtgttgtggctgaacatgatttctttacatttgatattgatggtagtcgcgtgccacatatagttcgtaggaatctttcaaagtatactatgttagatctttgctatgcattgcgtcattttgatcgtaatgattgttcaatattgtgtgaaattctttgtgagtatgctgattgtaaagaatcctacttttctaagaaagattggtatgattttgttgaaaatcctgatattattaatatatataaaaaattaggccctatttttaatagagctttacttaatactgtcatttttgcagacaccttagttgaagtaggtttagttggtgttttaactttagataaccaagatttgtatggtcaatggtatgattttggtgattttatacaaacagccccagggtttggtgtggcagttgcagattcttactattcttatatgatgcctatgttgactatgtgtcatgtattagattgtgaattatttgttaatgatagttatagacaattcgatcttgtacagtatgattttactgattacaagttagagttgtttaataagtattttaagtattggggtatgaagtatcatcctaatactgtggattgtgataatgataggtgtattattcattgtgctaattttaatatactatttagtatggttttacctaatacttgttttggtccccttgttagacaaatttttgtagatggtgtaccgtttgttgtttctattggttaccattacaaagagttaggtgtagttatgaacttagatgttgacacacaccgttatcgtttgtctcttaaagatttacttctttatgcagcagatcctgctatgcacgttgcatctgctagtgctctgcttgatttacgaacttgttgttttagtgtagctgccattacaagtggtataaaatttcaaactgtaaaaccaggtaactttaaccaagacttttacgagtttgttaaaagtaaaggcttgtttaaagagggtagtacagttgatttgaaacattttttctttactcaagatggtaatgctgcaattactgattataattattataagtataatttacctactatggttgatattaagcagttattgtttgtattagaagttgtttataaatattttgaaatttatgatggtggttgtataccagcatcacaagttattgttaataattatgataaaagtgctggttatccatttaataaatttggtaaagccagactttattatgaggcattatcatttgaggaacagaatgaaatttatgcatatactaaacgtaatgttctgcccaccttaactcaaatgaatttaaaatatgctatcagtgctaagaatagagctcgcactgtagcaggtgtttctattcttagtactatgacaggccgaatgttccatcaaaaatgtttgaagagtatagcagctacccgaggtgttcctgttgttataggaaccactaaattttatggtggttgggacgatatgttacgtcatcttataaaggatgttgacaaccctgttcttatgggttgggattatcctaaatgtgatcgtgctatgccaaatattttgcgtattgttagtagtttagttttggcccgcaaacatgaattttgttgttcacatggtgatagattttatcgccttgcgaatgaatgtgctcaagttttgagtgaaatagttatgtgtggcggttgctattatgttaagcctggtggtactagcagtggtgatgcaactactgcttttgctaattctgtttttaatatatgtcaggctgttactgctaatgtttgttctcttatggcctgtaatggccataagattgaagatttaagtatacgcaatttacaaaaacgcttatactctaatgtttatcgtacagattatgttgattatacatttgttaatgagtattatgaatttttatgtaagcattttagtatgatgattttgagtgatgatggtgttgtctgttataactctgattatgctagtaagggttatatagctaatataagtgtttttcaacaagttttgtactatcagaataatgtctttatgtctgaatctaaatgttgggttgaaaatgatattactaatggtcctcatgaattttgttcccaacatactatgttagttaagatagatggtgattatgtttatttaccatatccagatccttctagaattttaggagctggttgttttgttgatgatttattgaagactgacagtgttcttttgatagagcgctttgtaagtctagctatagatgcttaccctttagtacatcatgaaaatgaagaataccaaaaagtctttcgtgtatatttagaatatataaaaaaactgtataatgatcttggtactcagatcttagatagttatagtgttattttaagtacttgtgatggtttaaagtttactgaagaatcattttacaagaatatgtatttaaaaagtgccgtgatgcag

SEQ ID NO: 4243 - protein, 928 aa, Corononavirus-HKU1
SKDLNFLNRVRGTSVNARLVPCASGLSTDVQLRAFDICNTNRAGIGLYYKVNCCRFQRIDDDGNKLDKFFVVKRTNLEVYNKEKTYYELTKSCGVVAEHDFFTFDIDGSRVPHIVRRNLSKYTMLDLCYALRHFDRNDCSILCEILCEYADCKESYFSKKDWYDFVENPDIINIYKKLGPIFNRALLNTVIFADTLVEVGLVGVLTLDNQDLYGQWYDFGDFIQTAPGFGVAVADSYYSYMMPMLTMCHVLDCELFVNDSYRQFDLVQYDFTDYKLELFNKYFKYWGMKYHPNTVDCDNDRCIIHCANFNILFSMVLPNTCFGPLVRQIFVDGVPFVVSIGYHYKELGVVMNLDVDTHRYRLSLKDLLLYAADPAMHVASASALLDLRTCCFSVAAITSGIKFQTVKPGNFNQDFYEFVKSKGLFKEGSTVDLKHFFFTQDGNAAITDYNYYKYNLPTMVDIKQLLFVLEVVYKYFEIYDGGCIPASQVIVNNYDKSAGYPFNKFGKARLYYEALSFEEQNEIYAYTKRNVLPTLTQMNLKYAISAKNRARTVAGVSILSTMTGRMFHQKCLKSIAATRGVPVVIGTTKFYGGWDDMLRHLIKDVDNPVLMGWDYPKCDRAMPNILRIVSSLVLARKHEFCCSHGDRFYRLANECAQVLSEIVMCGGCYYVKPGGTSSGDATTAFANSVFNICQAVTANVCSLMACNGHKIEDLSIRNLQKRLYSNVYRTDYVDYTFVNEYYEFLCKHFSMMILSDDGVVCYNSDYASKGYIANISVFQQVLYYQNNVFMSESKCWVENDITNGPHEFCSQHTMLVKIDGDYVYLPYPDPSRILGAGCFVDDLLKTDSVLLIERFVSLAIDAYPLVHHENEEYQKVFRVYLEYIKKLYNDLGTQILDSYSVILSTCDGLKFTEESFYKNMYLKSAVMQ

SEQ ID NO: 4244 - DNA, 4071 bp, Corononavirus-HKU1
  CDS (1)..(4071)
atgttattaattatttttattttgcctacaacattagctgttataggtgattttaattgtactaattttgctattaatgatttaaacaccacagttcctcgcataagtgagtatgttgtggatgtttcttatggtttgggtacatattatatacttgatcgtgtttatttaaatactactatattatttactggttatttccctaaatctggtgccaattttagggatctatctttaaaaggtactacatatttgagtactctttggtatcagaaaccctttttatctgattttaataatggtattttttctagagttaagaatactaagttgtatgttaataaaactttgtatagtgagtttagtactatagttataggtagtgtttttattaacaactcttatactattgttgttcaacctcataatggtgttttggagattacagcttgtcaatacactatgtgtgagtatcctcatactatttgtaaatctaaaggtagttctcgtaatgaatcttggcattttgataaatctgaacctttgtgtctgttcaagaaaaattttacttataatgtttctacagattggttgtattttcatttttatcaagaacgtggcactttttatgcttattatgctgattctggcatgcctactacttttttatttagtttgtatcttggtactcttttatctcattattatgttttgcctttgacttgtaatgctatatcttctaatactgataatgagactttacaatattgggtcacacctttgtctaaacgccaatatcttcttaaatttgacaaccgtggtgttattactaatgctgttgattgttctagtagtttctttagcgagattcaatgtaaaactaaatctttattacctaatactggtgtttatgacttatctggttttactgttaagcctgttgcaactgtacatcgtcgtattcctgatttacctgattgtgacattgataaatggcttaacaattttaatgtaccctcacctcttaattgggaacgtaaaattttttctaattgcaactttaatttgagtactttgcttcgtttagttcatactgattctttttcttgtaataattttgatgaatctaagatatatggtagttgttttaagagtattgttttagataaatttgccatacccaactccagacgatctgatttgcagttgggcagttctggttttctgcaatcttctaattataaaattgacactacttctagttcttgtcaattgtattatagtttgcctgcaattaatgttactattaataattataatccttcttcttggaatagaaggtatggttttaataattttaatttgagctctcatagtgttgtttactcacgttattgtttttctgttaataatactttttgtccttgtgctaaaccttcttttgcttcaagttgcaagagtcataaaccaccttctgcttcctgtcctattggtactaattatcgttcttgtgagagtactactgtactcgaccacactgactggtgtaggtgttcttgtttacctgatcctataactgcttatgaccctaggtcttgttctcaaaaaaagtctctggttggtgttggtgaacattgtgcagggttcggtgttgatgaagaaaagtgtggtgtattggatggatcatataatgtttcttgtctttgtagtactgatgcctttctaggttggtcttatgacacttgcgtcagtaacaaccgttgtaatattttttctaattttattttaaatggtatcaatagtggtaccacttgttctaatgatttattgcagcctaatactgaagtttttactgatgtttgtgttgattacgacctttatggtattacaggacaaggtatttttaaagaagtttctgctgtttattataatagttggcaaaatcttttgtatgattctaatggcaacattattggttttaaagattttgttactaataaaacatataatattttcccttgttatgcaggaagagtttctgctgcttttcatcaaaatgcttcctctttggctttactttatcgtaatttaaaatgtagctatgttttgaataatatttctttaactactcagccatattttgatagttatcttggttgcgtttttaatgctgataatttaactgattattctgtttcttcttgtgctcttcgcatgggtagtggtttttgtgttgattataactcaccttcttcttcctcttcgcgtcgtaaacgtagaagtatttctgcttcttatcgttttgttacttttgaaccctttaatgtcagttttgttaatgacagtattgagtctgtgggtggtctttatgagatcaaaattcccactaactttactatagttggtcaagaggaatttattcaaactaattctcctaaagttactattgattgttctttatttgtctgttctaattatgcagcttgccatgacttattgtcagagtatggcactttttgtgataatattaatagtattttagatgaagttaatggtttacttgatactactcaattgcatgtagctgatactcttatgcaaggtgtcacacttagctccaatcttaatactaatttgcattttgatgttgataatattaattttaaatccctagttggatgtttaggtccacactgcggttcttcttctcgttctttttttgaagatttattgtttgacaaagttaaactttcagatgttggttttgttgaagcttataacaattgtactggtggtagtgaaattagagatcttctttgtgtacaatcctttaatggtattaaagttttgcctcctattttgtctgaatctcaaatttctggttacaccacagccgctactgttgctgctatgtttccaccatggtcagcagcagctggcataccattttctcttaatgtacaatatagaattaatggtttgggtgttactatggatgttcttaataaaaatcaaaagttgatagctactgcttttaataatgctcttctttctattcagaatggttttagtgctaccaactctgcacttgctaaaatacaaagtgttgttaattctaatgctcaagcacttaatagtttgttacagcaattatttaataaatttggtgcaattagttcttctttacaagaaattttatctcgtctcgatgctttagaggctcaggttcagattgataggcttattaatggtcgtttaactgctttaaatgcttatgtctctcaacagcttagtgatatttctcttgtaaaatttggtgctgctttagctatggagaaggttaatgagtgtgttaaaagtcaatctcctcgtattaatttttgtggtaatggtaatcatattttgtcattagttcaaaatgctccttatggtttgttgtttatgcattttagttataaacctatttcttttaaaactgttttagtaagtcctggtttgtgtatatcaggtgatgtaggtattgcacctaaacaagggtattttattaaacataatgatcattggatgttcactggtagttcttactattatcctgaaccaatttcagataaaaatgttgtttttatgaatacttgttctgttaattttactaaagcgcctcttgtttatttgaatcattctgtaccaaaattgtctgattttgaatctgagttatctcattggtttaaaaatcaaacatccattgcgcctaatttgactttaaatcttcatactattaatgctacttttttagatttgtattatgagatgaatcttattcaagagtctattaagtctttgaataatagttatatcaatcttaaagatataggtacatatgaaatgtatgtaaaatggccttggtatgtttggctactaatttctttttcatttataatattccttgtattgctcttttttatatgttgttgtactggttgtggttctgcatgttttagtaaatgtcataattgttgtgatgagtatggtggtcatcatgattttgttatcaaaacatctcatgatgattag

SEQ ID NO: 4245 - protein, 1356 aa, Corononavirus-HKU1
MLLIIFILPTTLAVIGDFNCTNFAINDLNTTVPRISEYVVDVSYGLGTYYILDRVYLNTTILFTGYFPKSGANFRDLSLKGTTYLSTLWYQKPFLSDFNNGIFSRVKNTKLYVNKTLYSEFSTIVIGSVFINNSYTIVVQPHNGVLEITACQYTMCEYPHTICKSKGSSRNESWHFDKSEPLCLFKKNFTYNVSTDWLYFHFYQERGTFYAYYADSGMPTTFLFSLYLGTLLSHYYVLPLTCNAISSNTDNETLQYWVTPLSKRQYLLKFDNRGVITNAVDCSSSFFSEIQCKTKSLLPNTGVYDLSGFTVKPVATVHRRIPDLPDCDIDKWLNNFNVPSPLNWERKIFSNCNFNLSTLLRLVHTDSFSCNNFDESKIYGSCFKSIVLDKFAIPNSRRSDLQLGSSGFLQSSNYKIDTTSSSCQLYYSLPAINVTINNYNPSSWNRRYGFNNFNLSSHSVVYSRYCFSVNNTFCPCAKPSFASSCKSHKPPSASCPIGTNYRSCESTTVLDHTDWCRCSCLPDPITAYDPRSCSQKKSLVGVGEHCAGFGVDEEKCGVLDGSYNVSCLCSTDAFLGWSYDTCVSNNRCNIFSNFILNGINSGTTCSNDLLQPNTEVFTDVCVDYDLYGITGQGIFKEVSAVYYNSWQNLLYDSNGNIIGFKDFVTNKTYNIFPCYAGRVSAAFHQNASSLALLYRNLKCSYVLNNISLTTQPYFDSYLGCVFNADNLTDYSVSSCALRMGSGFCVDYNSPSSSSSRRKRRSISASYRFVTFEPFNVSFVNDSIESVGGLYEIKIPTNFTIVGQEEFIQTNSPKVTIDCSLFVCSNYAACHDLLSEYGTFCDNINSILDEVNGLLDTTQLHVADTLMQGVTLSSNLNTNLHFDVDNINFKSLVGCLGPHCGSSSRSFFEDLLFDKVKLSDVGFVEAYNNCTGGSEIRDLLCVQSFNGIKVLPPILSESQISGYTTAATVAAMFPPWSAAAGIPFSLNVQYRINGLGVTMDVLNKNQKLIATAFNNALLSIQNGFSATNSALAKIQSVVNSNAQALNSLLQQLFNKFGAISSSLQEILSRLDALEAQVQIDRLINGRLTALNAYVSQQLSDISLVKFGAALAMEKVNECVKSQSPRINFCGNGNHILSLVQNAPYGLLFMHFSYKPISFKTVLVSPGLCISGDVGIAPKQGYFIKHNDHWMFTGSSYYYPEPISDKNVVFMNTCSVNFTKAPLVYLNHSVPKLSDFESELSHWFKNQTSIAPNLTLNLHTINATFLDLYYEMNLIQESIKSLNNSYINLKDIGTYEMYVKWPWYVWLLISFSFIIFLVLLFFICCCTGCGSACFSKCHNCCDEYGGHHDFVIKTSHDD

SEQ ID NO: 4246 - DNA, 1326 bp, Corononavirus-HKU1; identical to SEQ ID NO: 2954
  CDS (1)..(1326)

SEQ ID NO: 4247 - protein, 441 aa, Corononavirus-HKU1; identical to SEQ ID NO: 2955

SEQ ID NO: 4248 - DNA, 30 bp, Human corononavirus-HKU1
aaaggatgttgacaaccctgttcttatggg

SEQ ID NO: 4249 - DNA, 30 bp, Human corononavirus-HKU1
atttttatgtaagcattttagtatgatgat

SEQ ID NO: 4250 - DNA, 30 bp, Human corononavirus-OC43
taaagatgttgacaatcctgtacttatggg

SEQ ID NO: 4251 - DNA, 30 bp, Human corononavirus-OC43
atttttaaataagcattttagtatgatgat

SEQ ID NO: 4252 - DNA, 30 bp, SARS Coronavirus
cagtgatgtagaaactccacaccttatggg

SEQ ID NO: 4253 - DNA, 30 bp, SARS Coronavirus
ttacctgcgtaaacatttctccatgatgat

SEQ ID NO: 4254 - DNA, 30 bp, Human corononavirus-229E
ggccgatgttgatgatcctaaattgatggg

SEQ ID NO: 4255 - DNA, 30 bp, Human corononavirus-229E
ttatttgcaaaagcatttttctatgatgat

SEQ ID NO: 4256 - DNA, 30 bp, Human corononavirus-NL63
tgatggtgttgaaaaccctatgcttatggg

SEQ ID NO: 4257 - DNA, 30 bp, Human corononavirus-NL63
ttatcttaggaaacatttttcaatgatgat

What is claimed:

1. An isolated nucleic acid molecule comprising the nucleotide sequence of SEQ ID NO:2919, or the full length complement thereof.

2. An isolated nucleic acid molecule comprising a replicase gene of coronavirus HKU1 strain (CoV-HKU1), wherein the said replicase gene comprises a nucleotide sequence selected from the group consisting of SEQ ID NO:2920, 2922, 2924, 2926, 2928, 2930, 2932 and 2934.

3. A vector comprising the nucleic acid molecule of claim 1.

4. A vector comprising the nucleic acid molecule of claim 2.

5. An isolated host cell comprising the vector of claim 3.

6. An isolated host cell comprising the vector of claim 4.

7. An isolated replicase polypeptide encoded by the nucleic acid molecule of claim 2.

8. An isolated nucleic acid molecule encoding the polypeptide of claim 7.

* * * * *